United States Patent 9,328,346 (POLYCOMB-ASSOCIATED NON-CODING RNAS) - sequence listing, part 129

SEQ ID NO: 191575 - RNA, 22101 nt, Homo sapiens
cucgccagaaaccugaaaccagccgcgugagucggcgacgcggauugcgccugcgcgcuuggggagagggggacccgaggaagagacugguucgccgcggggaccgggcagggcuccccgucggagugcacugcgccggacacuucaagugaguuccugugugauccucgcaggagccccgggacccgggccaagacacgccagaggggaaggaagugcccgagccgggauuggagccgggggcgucugaggagggaaacugaggcugcagaaguccguguggagaggggucggcguuggccugaggguccgggugggccucugaggaggggcgggucucuccgaggaaggacggccgcagcgugucucuaauucaggguuuuuucucgcucuguggcccaggcuggaguacagggguacgaucauagcucacugcagucaacuucucagacucaagcgauccucccaccucagccucccgaguagcuggaacuacagacgcugcaccaccacacuuggcuaauuuuuaaaauuuuauuuuuaauuuuuguagagacggcgggguugggggggcggguggcgggucuugcuauguugcccaggcuggucucgaacuccuggccccaagcccaaagcgauccuccugccugggccucccaaagugcuggaauugcaggcaugagccacuauacagccuaauucaggguuuuuuuuaaccagggugggguaaugagcuuguguaggaacaaaaugcaccccuauuuuucucuaugugaaguauagcauuuccuuuccugauugcuggagcagccuuagcagugccugaaacugugagggugaguguaaaugauaguuccagauaacaguuugugcagggccaggcaugguggcucacaccuguaaccucagcacuuugggagucugaggcgagaggaucacgugaggucaggaguucgagaccagccuggacaggauggcaaaaccccgucccuacugaaaauauaaaaauuggccuggaguaguggcgcguuccuguaaucccagcuacuugggaggcugaggcaugagcauggcuuaaacccgggaggcagagguugcauugagccgagauuguaccaccccacuccagccuggugacagagugagacgcaaaaaaacccaguuugugcagcaacuacaaggugguaucuuaagcugucacuuacauuuauuacugcuuugaaauuaugauagagucggccgggcgcgguggcucacggcuguaaucccagcacuucgggaggccgaggcgggcggaucacaaggucaaaagauccagaccauccuggccaacauggugaaacccugucucuacuaaaaauacaaaaauuagcugggcuugguggcaugcgucuguagucccagcuccaggggaggcugaggcaggagaaucgcuugaauccgggaggcggaaauugcagugagccgaggucacgccugaggacagagugagagacugucucaaaaaaaaaaaaagaaaagaaaagaaauuaugauagggucuuguuauuucaugcauugaaaauaagcaucuauacuaguauagcagaaauuuguuuuuaaagcauuuugaugccauuucaauaucauugcuuuuuguuuuguaauucuguguauuguaauuaaugcacguaaggcagggcauggaggcuuacgccugcaaucccaacacuuugggaggccaaggcuggaggauugcuugaggccaggaguucuagaccagccuggcaacauagggagacuccaucucuacaaaaaaauacaaaaaauuagacagguaugguggugugcaccaguagugcuaguuaauugagaggcugagguaggaggaucacuugagcccaggaguuggagguugcagugauugugcauuugcacuccacugugccaucgcacuccagccugggcaacaugaagaccccauuccacaaaaaagaaaauuacauaaacaccaugcuuguaagaaggaguggcagggcuugccagaugcagaaugauaaaggcccccugcacuaguuucacaaaaggugcuggucaggacaaucaucaaugcguuacauggaccugaguucaaagccagcccagcccaagcuggccagucucacccacugcacugcugcaggaccccagcaagucucuccccuugcugggccuaguuuuuuguuuguuguuguuguuguuguuuugagauggagucuugcucugucgcucaggcuggagugcaauggcgcgaucuuggcucacugcaaccucugccucccacguucaagugauucuccugccucagccucccaaguagcugggauuacaggggcacgcugucacgcccagcuaauuuuuauauuuucggcagagauaggguucaccacgucaggcuggucucgaacuccugaccugaggggauccacccaccuuggccucccaaagugcugggauuacaggcgugagccaccgcuccugaccuacugggccuaguuuuuaaucuguucaaucugccaucacuuguaagacuuuuccaaucgcaaccuucuaauauaaccagacucuaaaauacuuuaggcugggcaugguggcucauugcuguaaucccagugcuuugggaggucgaggcgagaggauugcuugaguccaggaguucaagaccagccugggcacauagcaagacccugucucuaccaaaaaauaaaauuagccaggcauaguggcucacaccuguaguuccagcuacucgggaggcugaaaugggaggaucgcuugagcacaggaggguggggcugcagugagcuaugucugaccugaaccuaggcuuucuaaccucugggcccauacuucuuauuuuauuuauuauuauuauuuuuuuuuuuuucugagacagagucucacugucacucaggcuggagugcaguggcgcgaucucagcucacugcaagcuccgucuccuggguucaagcgauucuccuaccucagucuccucaguagcugggauuagacguguagcaccacacccagcucauguuuuuuguauuuuuaguagagauggggugucgccaggcuggucuugaacugaucugcccgccucggccucccaaagugcugggagugcaggcaugagccaccgccccuggccuguucuuuuucuuucuuucuuuucuuuuuuuuuucgagacagagucucacucugucacccagguuggaguaugguggcgcaaucucagcucacugcaagcuccaucucccagguucaggugauucuccugccucagccuccugaguagcugggauuacaggcgcacagcaccaagccuggcuaauuuuuguauuuuucauagagacgggguuucaccauguuguccaggcuggucucaaacuccugaccucaagugauaugccagccucgaccucccaaagugcugggauuacaggcaugagccaccgcgccuggccugggcccauacuuguaaccacuucuuucuuucugccuuuuguuacuaggaacugaguugacucucuuauuuuuccugauauauuccaggcccuggagggacaggaaagccagaaauggacuucgugagacucgcucgacuguucgccagggcccgccccaugggacuguucauccugcaacaccuggaccccuguagagccaggugggcaggaggcagggaggggcugaugcggccaaugugggcgcccuucagcagcuccuccucucagcugccccucggccaggagcgucaggaaaacacgggcagccugggcucugacccgagccacuccaacuccacggccacgcaggaagaagacgaggaggaggaggagaguuuugggacccucucugacaaauacuccucccggagacuauuccgcaaauccgcagcccaguuccauaaccugcgguuuggggaacggagagaugagcaaauggaaccggagcccaaauuauggcgaggccggagaaacaccccguacugguacuucuugcagugcaaacaccugaucaaggaagggaagguaaggggcacuuuggguucuguggcuccuggcuucuuuccccugguggcucaguguuuugcaaggggucaccugacuuucccagccucuaaguuuugggccuacccuguugaacugccagccuuauggcuguaaguaucgcaacccuuugccauccuccaccgcaguuuuauuuuauuguauuuuuuuuuuuuuguagagacggagguugcacugagcugaucuuaccacuagacuccagccugagucacagaacaagagucugucucaaaaaaaaaaaaaggaaaaagaaaagugaauccuccacacccuucuagcacucccugcuuuagguuuuuuuuauaacaggaucucacucugucgcccaggcuggagugcaguggcacgaucuuggcucacugcagccuccgccuccuggggaauucaagcaauucucccaucucaacauccugaguagcugggauuacaggcaugugccaccacaccuggccaauuuuuguauuuuuaguagagaugggguuucuccaugauggccaggcuggucucaaacuccagaccucaggugauccgcccgccuuggucucccgaaaugcugggacuacaaacaugagccauuacaccuggccgcugcuuuaguuuuguucguaccaccugucaucacuugauauacugugugucuuucuuaauuaucccauuucaugucugucugguuuguuuuuuuguuuuuuuuuuuuuuuugagauggagucuuguaccgucacccaggcuggagugcaguggugaaaucuuggcucaccguagccucugccucccggguucaagcaauucuucugccuuagccuuccaaguagcugggauuacaggugugugccaccaugccuggcuaauuuuuguauuuuuaguagagacgggguuucaccauguuggccaggcuggucucgaauuccugaccuugugaucugcccgccucagccucccaaagugcugggauuacaggcgugagccacugcgccuggccucaugucugacuuuccacaccaaaacaugagcuccaagaaggagcucucucuuguucccagccguauaugcaguggauagaccuugucuggcucauugaagcacucaguaauuauuguuugaaugaacagaugaaaauaaugaaggaauaaaggaaugaacugaggcuucaccggggaaauggugugaggugagggauggggcagaaacagcugggggcccaggggguuugcagucacccagggccgccguucuccaccauuuuaggagggucccucagcuucaaccucccucucucugcugagggucucuggggccauucugagccccugcccuguugccucuucccugcagcugguugaagcccuggaccuguuugagaggcagaugcugaaggaggagcgauugcagcccauggagagcaacuacacggugcugauugggggcugcgggcggguuggcuaccugaagaaggccuucaaccucuacaaccaggugcaugugggcgcagggcagccggggugaggcucugaaaagcugggggcggaucccaagugugccacuugcuagugcuuuacacugggcaggugacuucaccucccuggccucagagucaucuccuuaaaaugguggugauugugggugauaaacgagaugacauggaaagcccuuuagcaccugccuggacuguggcgguccccauguucccuuucuuuucccuucaaaaaaaaacagagggagccucacucugucaccuaggcuggagugcagucauagcucacugcagccuccaacuccuuggcucaagaguuccuccugccucagccucgccaguagcugugagcacagguguguagcaccauaucuggcuaauuuuuaaguuuuuuguagaggugggauugugcugcuuugucuaggcuggucucuaaccccuggccauccgccucagccucccaaagugcugggauuacaggucacagcccagccaccgcaucugcuccucugaagggggccagccccuccacaccugugggcguuucucgucaggugggacgagagacugagaaaagaaauaagacacagagacaaaguauagagaaagaacagugguccccugggaccggugcucagcauacgcucagcaucccgcauacggaggaccugcgcauacggaggaccugcgcugcgcaggcacuggucucuugaguucccucaguauuuauugaucacuaucucuaccaucucggagagggggauguggcaggacgauaggguaauggggagagggucagcaggaaaauaugugagcaaaggucucugugucauaaauaaguuuaaggaagggugcugugcuuugaugugcaccuacacaacaucucgugcaucaaagagcaguauugucuccagcaggucccaccuccagcccugaggcgguuuucgccuaucucaguaaauagaacacacaaucugguuuuacacccaagacauuccauucccagggacgagcaggagacagaugccuuccucuuaucucaacugcaaagaggccuuccucuuucacuaacccuccucagcacagacccuuuaugggcgucgggcugggggacaggcugggagacagucaggucuuucccuucccacgaggccauaucucaggcuaucacauggggagaaaccuuggacaauaccuggcuuuccugggcagaggucccugcggccuuccgcaguguauugugucccuggguacucgagauuggagaauggcgaugacuuuuaucaagccuacugccuucaagcacuuuuuuaacaaagcacacccugcacagcccuaaauccauuaaaccuugagucaacacagcucaugucucugcaagcacaggguuggggcuaggguuacaguuuaacagcaucucaaggcagaagaauuucucuuaguacagaacaaaauggaguuucuugugucuacuucuuucuacauagacacaguaacagucugaucucucuuucuuuuuccuacaguccuuuuuuuuuggagacagagucucgcucugucgcccaggcuggagugcaguggugcgaccucggcucacuggaaccuccgccuccugggcucgagcaguucucauaccucagccucccgaguagcugggacuacaggcgcacaugccaccaugccuggcucauuuuguuuguauuuuuaguagagacagcauuucaccauguuggccaggcuggucucuugaccucaagugguccacccgccuuggccucccaaagugcuagaauuacaggcgugagccaccgcacccagcccauuacaucuauuuuaaaaaacuauuauuuuuggccaggugcgguggcucacaccuguaaucccaccauuuugggagcccaaagugggcggaucacgaggucaagagauugagaccauccuggccaacauggugaaacccugucucuacuaaaaauacaaaauuuagcugggcgugguggcacguaccuguagucccagcuacucaggaggcugaggcaagggaaucacuugaacccaggaaguggagggaggucguagugagccgagaucacgccacugcacucuagccuggcgacagaguaagacuccaucucaaaaaaaaagaaaaaaaacuaauauuuuuauuguuuuuauuuauuuuauuuuauuuauuuauuuuuuugagacgggaguuuuggcucugucacccuggcuggagugcaguggugcgaccucggcucaaugcaaccuccaccucccagguucaagcaauucuccugccucagccucccgaguagcugggauuaaaggcgcccaccaccaugccuggcuaauuuuuuuguguuuuuuguagaagacgggguuucgccauguuggccaggcuggucucgaacuccugaccucaggugaucugcccaccucagccuuccaaagugcugggauuauaggcgugagccacggcacccagccuuguuacuguuuuuggugacucaccugcagugugucucccuucuugaguguaagcucaguaaggauaggcugugcccgcucugcuaaccccagggcugcugcugggcagguagugaguugucagugcaccucuguggagugcagcaauacacgcagagcuuacaucauccucaaaguagggacugcccucuuugcuuuucagauaaggaaacugaggcacagagagaugaagggacauguccaaggccaccccacuugaaugcaccggggcugggauuugagccccagauggccugacucuagcaggguucuuucugccgcugagcugccuaucgccugccuuuguccagauggcccuucucuggccaauagcgagugcuaggcuucaccacggauugucaacccugagcacaugccuuaguccccuggaggcucaguaagcugagugucacucagcuccggggcuugugacuuaccagaucagguggcccugagaaugugcauugugccacugguucggggccaccccuagagcacugcagugcauccucccacuugccacaggcaugccugguuucaaggugauggugucauccccauuuucgcgaggaagugcuaacuugcccgggagcccucagguaguaagcacuacaggcccuuuccccuugacgggguggccugaagguggggacaucaggaagaccuugcugccaggaccccaggccuggagugggcugacaagugcccagggcaggguagcuccuguuugguacaucugggugugugggcucaguuuucagagucccuucaaugugucugaguuuggagagcugggcucugauguguccauggcucugccuuagagccuggccugguggaugcagugacgggguccucuccagccucagccuccucuggggcagcugcucaccugugcguccagcugaucccgggccaccacugagcuucuuccaucuccacagaugaaaaagcgggaccuggagcccucggacgccaccuacacggcccuguucaacgucugugccgagucccccuggaaggacucagcucuacagagcgcccugaagcuccggcagcagcugcaggccaaaaacuucgagcucaacuugaaaacauaccacgcgcugcugaagauggcugccaagugcgcagaccuuaggaugugccucgauguguucaagguggggcuuccccugccguccugcuccccuucauggggcuggucccacgugucaggggcagggcuguggugucugucucuccucauguaggaaggcuuagggaggaugagacagccgguauugggcccugggguucacagauggaucugaugagaccuuacuggagauuguguaugccaccgugugcuguguccugcuuugugcacucgagggaaggcuuccuagagacagggucuugcuauguugcccaggcuggucacaaaacuccuggccucaagugaucauccugccuuggccucccaaugugccaggauuacagacaugagcuaccaugcccagccugcugcagguucucagugggacgucuuuguucccucccccaggaaaucauccacaaagggcacguggucacagaggagaccuucaguuuccugcucaugggcugcauccaagacaagaagacaggcuuccgguacgcccuccagguaugucccucccaccccaccuuccugcccugcuuccccggugccagaggugcaaaauggugauccugugagcacccacgauggcccugugcugaguauuuuuauaucugugcucuuuucugaaaacccagcagccacuguagccuccauucuacagauggcagggagaggaggcccuuggagauggaaugaggguggcccccgccccucccacccugcuuugcagucggcuuagccccucuaaacucaccuuccuugaaagccugccacacacucaccuggggacuuguucaacccucccacacccccauuagcacuucugcaggugcaacccaggagucauucauucauucauucauucauuuauuuugagauggagucucacucuugcccaggcuggagugagcgaucuuggcucacugcaaccuccgccucccagguucacgcgauacuccugccucagccucccgaguaguugagauuacaggcgcccgccaccacgcccagcuaauuuuguauuuuuaguagagacgggguuucaccauguugaccaggcuggucuugaacuccuggccucaugugaucugcccgccugggccucccaaagugcugggauuacaggugugaaccacagcuccccgcuggagagcuuuuuuuuucuuuuucuuuuuaauguuuuuaauuuuuuuuuuuuuuuuuugagauggagucuugcucugucgcccaggcuggaguacaguggcaugaucucggcucacugcaagcuccaccuccuggguucacaccauucucccgucucagccuccugaguagcugggacuauaggcgcccaccaccaugcccagcuaauuuuguuuuuguauuuuuaguagagacagaguuucaccauguuagccuggauggucucgcucuccuaccucgugauccggcgccuugcucucccaaaaugcuaguauuacaggcgugagccaccgcgcccggccaauuuuuuuuuuuuuuuuauugaucauucuuggguguuucuugcagagggagauuuggcagggucauaggacaauaguggagggaaggucagcagauaaacaagugaacaaaggucucugguuuuccuaggcagacgacccugcggccuucugcaguguuugugccccuggguacuugagauuagggaguggugaugacucuuaaggagcaugcugccuucaagcaucuguuuaacaaagcacaucuugcaccacccuuaauccauuuaacccugaguggacacagcacauguuucagagagcacaggguuggggguaaggucacagaucaacaggaucccaaggcagaagaauuuuucuuaguacagaacaaaaugaaaagucucccaugucuacuucuuucuacacagacacggcaaccauccgauuucucaaucuuuuccccaccuuuccccccuuucuauuccacaaaaccgccacugucaucauggcccguucucaaugagccgcugggcacaccucccagacggggugguggccgggcagaggggcuccucacuucccagcaggggcggccgggcagaggcgccgcucaccucccggacggggcggcuggcugggcggggggcugaccccccccaccucccucccggacggggcggcuggccuggcagaggggcuccucacuucccaguaggggcggccgggcagaggcgccccucaccucccggacggggcggcuggccgggcggggggcugaccccccaccucccucccggacggggcggcuggccgggcggggggcugacccccccaccucccuccuggacggggugcuagccgggcagaggggcuccucacuucccaguaggggcagccgggcagaggugccccucaccucccggacggggcggcuggccgggcagggggcugaccacccccaccucccucccggacggggcggcuggccggguggggggcugacccccaccucccucccggacggggcggcuggccuggcgggggcugacccccaccucccucccggacgggguggcugccgggcggagacgcuccucacuucccagacagggugacucccgggcggaggggcuccucacuucucagacggggcggcugccaggcggaggggcuccucacuucucagauggggcgguugccaggcagagggucuccucauuucucagacggggcggccgggcagagacgcuccucaccucccagacggggucgcggccgggcagaggcgcuccucacaucccagacggggcggcggggcagaggcgcuccccacaucucagacgaugggcggccgggcagagaugcuccucacuuccuagaugggauggcggccgggaagaggcgcuccucacuuccuagaugggauggcggcugggcagagacgcuccucacuuuccagacugggcagccaggcagaggggcuccucacaucccagacgaugggcggccaggcagagacgcuccucacuucccagacgggguggcggccgucuuggcacuuugggaggccaaggcaggcggcugggagguggagguuguagcgagccgagaucacgccacugcacuccagccugggcaccauugagcacugagugaacgagacuccgucugcaaucccggcaccucgggaggccgagguugguggaucacucgcgguuaggagcuggagaccagccuggccaacacagcgaaaccccgucuccaccaaaauaauacaaaaaccagucaggcgugguggcgcgcgccugcaaucgcagguacucggcaggcugaggcaggagaaucaggcagggagguugcagugagccgagauggcagcaguuacaguccagcuucagcugggcaucagagggagacuguggaaagagggagagggagaccguggggagagggagagggagaccguggggagagggagagggagagggagagggagaccauggggagagggagggggagagggagagggagagggagaggcccggccaauuuuuuaaauguuuuacaguuguuuugagacacucucgcucugucacccaggcuggagugcuguggcaugaucacggcucacugcaaccucgaucucuggguucaagugauucucccacuucagccuccugaguagcugggacugugggcaugcaauaccacacccaauaauuuuuguauuuuuaguagagaugggguuucaccauguuggucgggcuggucucgaacuccugaucucaaggagucugccugccuuagcuuccuaaaguguugggauuacaggcgugagccaccgcgccuggcguauuuuuuugaggcagggucuugcuauguugcccggucuugucucgaacuccugaucucaagggauccucccaucuaaaacucccaaggugcugggauuccaggcgugagcccugcgcccagcugcugaaugggagcacccagcugacguuugucucuuccguggcagguguggcggcugaugcugagucuagggcuacagccgagccgggacagcuacaaccugcuguugguggcagcucgggacuguggccuaggggacccccagguggccucagagcugcuucugaagcccagggaggaggcgacugugcuucagcccccagugagcaggcagcggccaaggaggacagcccaggccaaggcaggcaaccucaugucagccaugcugcauguggaggcccuggagaggcagcuguuucuggaaccuucucaggcacuugggccuccagagccuccggaagccagagugcccggcaaggcccaaccagagguggauacuaaggcagagcccagccacacagcagcccucaccgcaguggcccugaagccaccucccguggagcuggaagucaaccuccugacccccggggccguucccccuacaguggucuccuuuggaacggugaccaccccagcugaccggcuggccuugauagggggccuggagggcuuccugagcaagauggcagagcacaggcagcagcccgacaucaggacccucacgcuacuggccgaggugguggaguccgggaguccugcagaguccuugcugcuggcccuccuggaugagcaccagguagaggccgaccugacauucuuuaacacgcuggugagaaagaagagcaagcugggagaccuggagggggccaaggcgcuguugccgguccuggcaaagaggggccucguccccaaccugcagacauucugcaaccuggccaucgggugccacaggccgaaggacggucuacagcuucucacagacaugaaggugaguggacucgggccugggcaggacacccauggugcucaggagcacucugcagcucaggaggaaaguuugaggggucugcagaccccccaccuggagaggaugaacugugcauggggcaaagagaguggggucaaugaccuucuggucuuuggucccauuuugggggaagcagaccccagugagugcuucagggcugggcguagagacacacggauguucccauccggaagaagguggccguggguugacacagggcugggcacaggccucggccccaacacucuagagguauggcagggauucucagaauuccugaggggccgugggcaguuuucaaagcccccgaggucugugccucccaccuaacccccauuggaagugcugcguggauuucauccgaccacagcagaggcugcguccuggguugucgguguccccagguccaucauccucuggcuguuuuccuggacccuaccgggcucacccagccaaggcuugcacuuuucuaggccaaccaccaccuggugaccgugcgucacaggaagcccaccccagggagcaaggagguggugucucccacaucauuuucugccugagucagucggugucugagagcagcacgagcguccuuuuccgcagcuucuuuagggcugagcagaggggcugggcuuggcuuuccugcuggagagggauauucagcacauuguugcugccaaguuugccuugcuggcccuggccgcuggucccgggagccagcuugauugacagagggugggagcugcugggucccaauggcugccaucaucuugauucuacgaugucccuguguucuagaagucccaggugacccccaacacucacaucuacagugcccucaucaacgcggccaucaggaagcugaacuacaccuaucucaucagcaucuugaaggacaugaagcagaacagggucccggugaacgaaguggucauccgccagcuggaguuugcagcccaguacccucccaccuuugaccgggugugugccccaagcucaaaagcucaucagcuccuucaccauugcuacccccuccccccaccacccaaccccgguucuggcccuugggauuguguugccaugcuugaaacuguccagcagcuucccuuaggagcaguacccaagucuguagaccacagccugcgagucccugucugcguggcucaucucaugucucagccuugcguuugcuuucucugucugucccaguggccuucugucaguucgcagaggccaccaaccucuugccugcuucgggauugguguucccgcugccucagguggcacccacuuuuccuggaggucucugcuuaaguggcccucagacaugcccagcuggcugccgcucugaccugggaugaaagucuccccucccccuucccacucuguuccuuuaugccguguccuacagucuuggaucaugugcucaugggcagcccuggccuucccuguaucaggcuucuggaggcagaggcugucugcugugcucaucuggguccccagcaccugcacguugcuggguacuccaaacagguugucgcuugcucagggacugggcaggcagugaaguggugucauugucuggggugaauaccugagauuuguugugagccaagaucgcgccacugcacuccagccugggcgauagauggagacuuggucucaaaaaaaaaaaaaagagguuaagagcugaaguuuaauaggcgaaagaaagaagagcucucgcccggugugguggugaaaaaaaaaaaaagagaagagcucucuccuugcagagagaggugccagagaaguggguugccacuuccauaguguaaugcagagguuuuguagaugagcuuggggagguggugucugauuuacagaggacgcaaaagauuaguuggaccaggugugccauuuacauagcauguauaaaagcuggugccccacccuaaccuuuuauuaugcagacagguggccaucgccauguugccugguucuuuacuguacacauggcaacaaagaagggaagauggggcccccacguugaacauaucuggcucccagguagcccuuuucuguuggcacagccgccagcauuuaccccugcaagcuuccaguuugcuuaucuaugucugcagcucgauuuuucaggcugcucuuuguuagaaaagaaauuauuugggggcugcuuuuuauuaaaagggaaauuucgccaaggacucuguugcccuuauuaucugccuaaauaauuucuuucaaccuccuguaucagcaggagcagggcagagucauggaaucugcuuugucacggccacagccucucccugcuguucugaggcuaucaggcucugggguuuggcuuuuggguccaucgaaucacacucugugcugagcaucuccggagcaucgagagccacuauggcuugaagcacagcccggauggggcggaaacaaguaaaugggcagggacacacacagcuagagggugcggggucaggaacgccgugcaggugucacgccugaaugccauuuugagggcuuccuacaaauaggugggacagcaauggaaauugugucuggcugaaggcauagcugggcauuuuugaacugugucugugcuuugaacuguugguugcaagccuuuucucauugauuccaggguuuuuuauauauucuggguacugguuuuuuguugaucacauguugugcauaucuuccuaguggauugucucuucccucuggcguagggcucacuagggguucaacucgacagucacaagacuaucauagaccuaaagcauaucauauuuaagucacagacagaugucccugacuuaaagaugauucuacacaggauuuuucaacuuugcaaugguuuuaucaggauguaacucuguaaggaucgacuuugugcgggguuaguuucuacugaauguauaucacuuuugcauaauuauaaagucaggacccucugcuguguugccagcaauagaugcauuuuccuuuuguuuuuuaugagauggagucucacucugucacccaggcuggagugcagugaugcgaucuggccucacugcaaccucugccgcccagguucaagugauuuuccugccucagccucccgaguugcugggauuacaggagccugccaccacaccaggcuaauuuuugugguuuuuuuuuuuuuuuuaguagagacgggguuucaccaucuuggccaggcuggucuugaacucccgaccucgugauccacccaccccagccucccaaagugcugggauuauaguugugagcccccaugccgugccgcauuuucuuuuuucuuuuuuuuuuuuuuuuuuaaagagacgggaaucacucuguugcccaggcuggagugcaguggcacgauuauggcucacuguagccuugaccucccaggcuuaagaaguccucccaccuuagccaccugaggagcugggacuacaggcauguaccacuguacccagcuaaucuuuuagauaggguuucacuauauugcccaaacuggucuggaacuccugagcucauguaauccgccugccucggcuucccaaagcacugggauuauaggagugagccagcacacacagccagauugauuuuugauuuacgauggguuuuuggggggcggaacccugcugucaggagcaucuguacucauauucccucaugaugguggacuuguuuauauucgugauucuguugaguuuugcuuucugugcuuucaggcucuauccggcaccuuaagguuuagaauuguccagucuuuugagucaaaccuuuuuuuguuuuuguuuuuuuuugagauggagucuugcucugucgcccaggcuggagugcaauggcgugaucucagcucacugcaaccucugccucccggguucaagccauucuccugccuuaaccucccagguagcuggggcuacaggcaugcaccgccacauccaguauuuuuaguagagauggaguuucaccaugcuggccaggcuggucucgaacuccugaccucaagugaucugcccaccucggccucucaaagugcugggauuacagacgugagccaccgcacccggccaaaccuuuugucauugugugguaguagcuguauguuggauagcacuuuuuggcuuuuuugguauauuccccuaccagcucucaguuugugucuggugugucuuugcuuuuuuccccauaucucauggagccuaucuuggcaguguugagauaauggucagagggagguggcuuugauggggaggggcucggcaggcuguggaggcagagcuggugggacccagugauucuggcuugggggccugggguggcaacugcggauggaggagcacaguggugccuauuugggaagaacgccauugggcagauggcucugggccugccccaggguacccagcggggaccuguuucucugaaguaagcuagucccauagugcguguucacagcuuuucugcccuguccucugcagccaccuggaagggaaaauggcagccaccagcuucccugaggccugagccagcugccgagguuugggauuagcuguagguaacaggagugauucuagccucacuuuucuaauucuaguaccaagggaagaacaccuaccuggagaagauugacggcuuccgagccuauuacaagcaguggcugacagugaugcccgcagaggaaaccccgcaccccuggcagaaguuccggaccaagccccagggggaccaggacaccggcaaggaggcugaugacggaugugcccuugggggcaggugaugggagcacagcuggaacaaugugcucggcccccagugcucugugggagccccaggacaagugagcuggugucaccuccugccugggggaagagccaggcccugaggaacagccgcagcgugucacagguguuggugaggacacacacuaggcccaaggugccugugcucccagcagguccaagugcagcuccagccaccuuugcgugucaccuucacgggacuuccagcuccagcuaccuuugugugucaccucacacaccacaagggggcuggggcaucuggucccuggggccugggccgccccgccggguuccauaggccgaugcucugaaagaagagacguggggcucgagagauuuaaagauuuuauuuuuacaaaucacagcugauagacagcgaagccuuccccauagagaccgugcuccaacucgggccuggggcacugcucgcugcucccaggaaggggguggcgugacaggcaggaaccugcgaaguccagaguccaggguggagcgcgccagccucagccagagcagccacgacagccacagugugugcacucgaugaugcggcccugcaacggaggaggacagugagacgaugccacugcgccacgcucgccccugcacacucacauauguggcaacccucccacgaaggaccugccaccaugccauauagggacacaccucagaaacccuuccuugacagcucuggacagggaaaauuuggcucccucaugaagguagaaccagcugcuguugacaccgagguuacaucuguaugucuauuuauaauauguucugcaaauccaacacacguuugccaaucaagaaaaagaaaucggugugaaugagucucguuauucugcuaagugagcaugacagacccugcgaugagcagacguggcucugcuacuguuuggggacuucaggggggccucugggcugguacacucuggugggggaagagggcaggagacuaugcacuugagucacacccuucuggcccagagccccccagaaagaagggucuugucccccaggccuggugcggcccaacacuuggccagccagaaagcccuagaacaguggcuuguguuuauuuuacuuuuucaaguucuuuuuuuggaagaacaagaccauaguuuaaguaaacaggauccucuggugaaacccagguaagucuacagcgggcuguuuuggccacagggcugaagcagcaccccagcccaccagccccugaccuggacuccuuguggaaucugggcacucagaggaagggggcuucugccacucugccaccugucccugccuccaucagaaaaccaacaccccagucuuccgucggggaggcggcccuugcucgcccccacugcucaguacccaaguccucagcauccagccacagcucuccauugucagucucacugcagcauaaaggggacucaugugaagaggccccuguguggagcuggggaaaagaaggccaggcuggcagaugggcgguggggccaacaacugugcugaggggcugcacugagcggccacugcugugacucugccucgggccacagcugccuuucagaggggcuuggaaccggauggagcucagcuccugucccucagcaccacuccugaggcgccuggccuaggagugguacuuggaacagaaaguucugaaagaagaaacacagugggcugggcgcaguagcucaugccuguaaucccggcacuuugggaggcugaggcggguggaucaccugaggucgggaguucgagaccagccugagcaacauugagaaaccccgucucuacuaaaaauacaaaauuagccaggcgugguggugcaugccuguagucccagcuacucaggaggaugaggcaggagaaccgcuugaacccgggagguggagguugcagugagccaagauggcaucacugcacuccagccugggcgacaaagcaagacuccgucuugggggggcgggaaagauagugaugguaauguuaaaguaucacugugaggacugaaagggacaggaacucacugguuguccuucccugaugucacccugccaccaccuugggauuagggcuccccaccaccauuuccuaagugaggaaagggguucaguaauuugcccaaaaguggaguugagauugaccccagaccuaacaaacacacagccacacgcugccucacauggauuccugaauacagggacccacucccacgagggagagccagcaggacauccagggacaaaacgacauuccagcccaaccaaauaacauaagaucccuugcagucgacuaaggcagaauuuugagcugaaaacaacaccaagcuugagugucagacauuaccacuuccagcuugcuuuugggcacgcggcagaugcaguucgucccgaaguuggugucccgugucugaaugcaccgcaggcagcacaaguucucauauccuugcuuuuuccauuuugcaaucagguuuuugucugcauagccuucuuuaauacaauauucauagaguucugucaaaaagauggggaaagagcaucaggccauggucuaaaaaccuuccccacccuugaucaaaaaaagcauucaggccgggugcaguggcucacaccuguaaucccagcacuuugggaggccgaggcaggcggaucaccugaggucaggaguucaggaccagcccggccaacaugguaaaaccccgucucuacuaaaaauacaaaaauuacucgggcgugguagcagcuguaaucccagcuacuuaggaggcugaggcaggagaaucacuugaacccaggaggcggagguuguagugaccugaggucgugccacuggacuccagccugggugacagcgaaacuccaucucaaaaaaaaaaaggcauucaguauugcaacgggacaguccuuggaggaggaacaaaaaaaaaaaguacuuaggccaggcaaggugccucacaccuguaaucccagcacuuuuggaagccaacgccagaggaucauuugaguuaagaaaccagccugggccaagggcccaucuccacaaaaaauuuaaaaauuagcugggugugguggugcacaccuguagucacagcuacucaggagguugaggugagaggaucccuugagcccagaagguugaggcugcagugagccaucauugcaccacugcacuccagccuguggaacagagcaagacccuguuuc

SEQ ID NO: 191576 - RNA, 15460 nt, Homo sapiens
agcucacuuccggaccgcggauagcacuggcgacccuagcgggugagaggcccuucagggccgcggcgggugagagccucuucagggccgcagcggguggcgggcgaagugguaaacgggcgcggggacggguuuuggugccgcuacggggcucggcggcagcgggguugcaguagagcccgucucccuccgcucagccccggcugagggcggcaagucucucaggagcugccuucagcggccccgaggcccugcgggucuggacgcugaggggccgccgcgcuguaggcucagguaggagcgaggcugaucccgcucugccaggcuuggcuuagugcagggcuggccacgaacccgaagagaucuugaaccaaagcagaacucugugcaaagugaaaguaaucacauaggacacuuauuuaaagaauagugaugagccagccuggucaacauagcgagacccugucucuacaaaaauugaaaaguagccgggcgugguggcacgcgccugaggucccagcuacucgggaggcugaggcaggaggaucgccugagcccaggaguucaagguugcacugacuuacauucaugccgcugcacuccagccugggcaacauggggagacccugucucuacaaaaauaaauaauuagcuggucaugguggcacucgccaguagucccagcuacucgggaggcugaggugggaggaucgcuugauccuaggaggcaaaggcugcagugaucgcaccacuggucuccagcuggggugauaaaacccugagauccugucucagaaacaaaacaaaagagucacaauggguggggggagauaaagaauagcaauggggcaauuucuauuugucaaauggcagagauaaaagaugaaugaggaucuuucuugccuccagggaaucuguuagagggagacacauggguaaacauuugcacuguagugcauuaaaugcacuaguggagugaaccaaugcaauagcuagaaaggaaugaaagagaaaucucaauguugcagagucaaugaauagacugaaaauauaaacuugguuuaaguggggguagauaaauacacaaacucacaauagaauauuuagcagaagcuuuggggugugccuccugccagcugcccauucucugcuccagucaggugaucuuuccguuuucugacaagcaggaucuccuuccccuggugcuuuggacuuccaagucugucuucccagucuaggucuuccgcauaauccacuuggagguaaauaggacucauucuccagucuacuucaagccucuucuuuuccuugaguacuuggacuuagauuaguuuucucucuuuuugacuucacauuuuuuuuucaaucuguaccauguauuuugggaggcaguuaucaucuagucucuuuuuuuucuucugagaaguaggaggaguagcacucauccuacagaaguguuuuaaguauuagaugaaauauguguucacaugcuuucuaaagaguaaagccuguacaaguuagaaaucuuuaggucauuugucauaaugguauauauguugcuccauugucuuuuucagguugagcgcaccaucacaucuaagccaucagcaaguuuguugguuuuaaucuccaaaauacgucuugauuuugucugacucuuugccaccacccugaucuaagcccuuaucaucugcuugaaucacuguaagugccauuucccucuugccaccucuagccuauucccugucaacacacaggcagaaugacuuuuauaaaacauguaguuccucgcuaaaguaagaaauaagaauaaaguucauaauucuuucuguggcgcaggcucugggugaucugguuucugucugccucugccaccucuucuggugcagcucugcucgucacugcugaagccacacugggauauggcuuguucuuggacacccagaguaauuucuuagccucagggcuuuugccuggaaugcucuuagaaugacugacucauucucauccuugagucagccugguaucaugucuuuagaaaagccuucuucaagucaguugcccccuguuaacagagcacccuacuuauuuucuuucuagaacuugucuccacuugcaguuuuuaaaagaguugcuuccauuugacuuuuucugucugcuguaccagcauaugaguuucaggaggguaagcucccagugugucuuguuuucuauuuuauuuguuguuucugccugccucuuguguguguauauguguguguuuguguguugcauguauguuuccuuuaguauuggaagaguaggcccuggugacucacccaguuauaacccauuauauauuauucucugauuguaguguuauucuccagugagauccuaaguuauuuguggguauaaaagcaaaaucuuagacauuuucuguuuagucucuguaccuaauaguugcuuagcaaaugauuacuauguugaauugaccugacuuuugggaucuguguucagucuuuugaaaaugccuuguaaaagguaauuacuguguucuccaguggaauauuccuugauguagagacagaacugggaugggcugaccuuucaugugucucuuguucucaaaagggucauugaugcagucauucucagucuccucggagggagucugaagaugcuuaaagagcauccagagauggcggaagcuccucagcagcaguuggguauuccuguggugaaacuggagaaagaguugccauggggcagaggaagggaggacccuaguccagagacuuuucggcugagguuucggcaguuccgcuaccaggaggcagcuggaccccaggaagcucuuagggagcuccaggagcucugucgucgguggcugaggcccgaguugcacaccaaggagcagauccuggagcugcuggugcuggagcaguuccucacuauccugccccgcgaguucuacgccuggauccgggagcauggcccagagaguggcaaggcccuggccgccaugguggaggaccugacagaaagagcacuggaggccaaggcggugggugaggaggggauccaggucuggcgcccuuggcgugggcagggaauguuaaagaauccaaagauuugaggaagcaguaggaguggacgagguguggagccgcccuccucugcccucagacucccugagguucuuuuuggagagcaguggcguuuucagcaagaaaggccauucccaggggagaugcugccaugcagaagggccugaagccucuguuuggucaugagggcagaggccuggccauauuucccuugugggcaucaggcaaaaagaaggcaguugugauuguuuuuggggucccucauagaccugacccugcuuuggacagagaugccucugggaaggcagagaaucccaccuggggaauauuuuuccggaaaaggguuguccauggcaguacuguuucucuguggcucauagggcuccuguaacaauucucuggugcugcucuaaugacaccaagugauuuggcaccgcacgugcuuccuugagguuccagccauauuucggucacuuugugguacagcccccugauggaugacugggaaaggagagcaggacugaugacaccgucuugcucacaagcccccguccuucuguaguucagccucccgugcacacucucgucacccugacuuccugucuucagaauccuaagagaauuuuuuccuacucaacucaggagcuuaaaaguggacccagaaaugccuuguuuuugugaguacuucucagugagagaguccuccugauuuuucuugcucuuuuuaauuuauuauuuuugagacagggucagucaacagccuaggcuggagugcaguggcacaauccuagcuuacugcagccuugagcuccuggcucaguugauccucccaccucagccuccugaguagcugagaccacaggcaugcaugccuggcuaauuuuuuuauuuuuuguagagauggagucucgccauguugcccaggcuuccuggcucucuuuaaagcaacuauuucucacuggccuguucacugcagggucuaggcuuugcauuuuuuauuuucagcuuuuucaauuaggaauuuuuuuuucuaguagugaguauauuguguuaaaauccucagcaggauaauauuugggcuuggugauggcagguagaggggacccuugucaaauggcguggacagauaaaaguugcucagggccugaugcaugaguuuagcuuccuuuucacuuccucacuaauguccuggggaagagcucagcugauuuuuccuuccucuccccugaagcuggaaugguucuuuucuugguucucuuuuuagauuuuaguucaacucccuucauaacagccuugcccaggccucauucuaaucgguguugggaacuguucuuagguuccaugccacaggcagggagagcaggaggaaacagcacuuugcagaggcgcuugggagccaggcauccagcuggggccaguggaggucaagccugaaugggggaugcccccuggggaaggaguucaagguccagacccagguaccgaggagcagcucagucaggacccuggagaugagacacgggccuuccaggagcaaggugaguaagacgcagauaguggggaugucaggucauaggaaacagugcugugcagccaacucucuucagaaacccagcaauggagcaacuaaguuacccacgagguguaauugugaauuuucuuggcuacuuccuccaccuuaggaaauagaugaagugaaauuguuucuucucccuuuacccucuggugucuggaggggauaucugggaucaugcuuucuuauuauuucucuuuucuuucccucagaucccuucuagaaacuaccaagaaauauucagcugacuugcaggaauacuuuuucaguaggcagauaaaccauaucccccaaaguaauauguagcuuucuuucuuucuuucuuucuuuuuugagauggggucucacucugucacccagguuggagugcaguggcgcgaucucagcucacugcaaccuuugccuccuggguugaagcaauucuccugcuucagccucccaaguagcugggccuacaggcaugugccaccaugcccuguuaauuuuuuuguauuuuuaguggagacgggguuucaccauguuagccaggauggucucgaucuccugaccucgugaucuguccaccucagccucccaaagugcugggauuacaggcaugagccaccgcgcccagcccacguagcuuuauuuuguuauugaaucucauaggagguuauucccagagugugacuggguagcauggguagcccuggacggacagggccgggacaaucuugccagcugagaacaggagacacccaggccccagcugagaauagggcaagggacacccaggccccugugcaugggaaagugugguaccagagugaaaagggauucugucuggagucuucugguuccugagguugugagcaucugguaggggacacauuugaacgagcuaacagcauaacaucacugauccuucugaucuuucucaugcuuuuugucccugcucagcacuaccuguucugcaggcggguccuggccuccccgcagugaaucccagagaccaagagauggcagcuggguucuuuacugcuggaucgcaggugagcucugacucccuuugcagaaaucaugaccguugcuuugauugagguucaccuuccccaagguuucucugcacaacaguguucccuucccgccccaaguugagucauucucccuuccuagucccgguggaccugauggugugguuuccuccacugaaccaucagccgcaguuguuaauuuacaucgaaccuuaugucugucgcccaggcuggagugcaguggcacggucuuggcucacugcaggcuccgccuccuggguucacaucauucuccugccucagccucccaagcagcugggacuacaggcaccugccaccucgccuggcuaauuuuuuguauuuuuaguagagacgggguuucaccguguuagccaggauggucucgaucuccugaucuugugauccacccacuucggccucccaaagugcugggauuacaggcaugagccaccgcgcccagccacagauggacucuuacaacuguuacagauagaaacccccuagggcuaucuaggcugugcugauuggccccgagauaacccuuugugggugccguuuauggguacuucugcugcugauuuuucuguuuuggaaacuuuccuguccccuaaccucagcaggaauguggcugacucaggguuggggcuuucagaagcauugagcaggguggucucuuuggccauacaggccacacuaggaguuggaccucguuaacauuacucaucugccacaaaugagguaacugaagcauagauggggugcucucuuuuccacagggugcugagcacuaguagcagggaggugggggcuuuccaguggggcaccuuccucaaggaggcgagucuaaaagaguucuuugaagaagaaaagguguuuggcagaaaaaagaaggggaucaagucugguccugcucaagccguauuugggcaaggcuggaugccagcaucauuucccuuuuccuguucuccaaggauguacuuuggaggggaugaggaaugacaucagugcuuuuuaauuugguuggauccucccuuguaccauaauaguucuucguggugcagugagugagaaauugaggaugcauuuauuuuaucacagccuuguucuuaagacagggcuuggccgaaugugaacuuuguucuugaugagaagguaaauagcggcugccaggcucugucaagcaugaggugugagugggaggcugcugcagaguggaaaugaggugacuuaguuguuaggggcaagcugagccccagccacagaggcucacaacugcaguggcucaaacaaguggauuacucccauucaacuguugggaggaagcugguugggaggaaguuggauuacagacaugagccacugucucuggccuaggauucuuucuuuauucauagcaaucuccuauuguugcagggguuggggccauuuaaagauauggcccuggccuucccugaggaggaguggaggcaugugaccccagcccagauagacugcuuuggggaguauguggaaccgcaggacugcagggucucuccagguaagacugucuccacccacaggugaggaacuggggaguucugaaagcucaggucagggguccugccguagcucuggcgcuccuggcaaaggaaggggacuucauggcaggcggguaaauggguccagcacggaccauggggcacgaggagcugcuuuccugugucaauagaggagccaaaugauggagcaggaaaacaugaggccauuauucuggcuguauggagacaggucggucaugaggacccccaaacaccuacauuguguccaugauuaaagacacugagggcuugagaacaagauacgaacagcaaaagauggggcaucugagcuuguucagauauuuauugagugcucccugcaugugggcccuguguuagugguuuucucuugcggcaggaagugggcaggacuaacgugcacgaaagcguuggagcucacggugugcacguaggagggcacgagggggcuucgcgaugggagagguuggaguggcccgagucacagaggaagcagagcugcgcugggacucaggugguggcuggguuugaccugggcucagagccuggggggaugcggccauugugugugacagcagcucaugggaggaggagcagcgagagagagcccacaggggcugccagcagagcgcacugcggggcuuuggggcugccagggcaagggacaguauggagagucugcaugcguggaaucaggaugccggcggggagaggaaacacuguggcuggagcggccuguccuuguucuuugauuuucuucuuuuuuguuucauaacuucuuugugaguuguacacugaccacccaucuguaccgaccccaccuagccuuuccuuauccugaaaugccuugaaggaagagcaagauuaucccugugcuuccuucaggacguaagagaauccauccugccccuccacuugcugacccugaccuugagcaucucccuugagcuuuccaggucucaguuuccucuguuguggaauggggcuguucauggaaccuguccucauggugccaugaggaugaagggaggugacauaucuaaauguguggugaccaugguaguguuagauuguuuaguuagugcuguaaguauuacuaagggauucuuguaggagcccucagccuucacucauuuauucaccacagagguggacuuggcucuguggccauugcuguucuggucacuaugaagaguuaaaaauaaaggcgcuugccuguggggucuuagaguucaggggaagaggccaugugcauguaauagugggauacgguaaggggcacuggucuccugggagaccuggguccagggcacgguugacacaguguggcagugaugcaaguggcagaaagaugucagcauacuuuauguggagaugugugauugcuguaacggcagaggaugacagaacaaagcaggggcucgagugaugagccccagacaaaggugccaguguccuggugccagggucccccucagggauauuccccucccagugaugcugcuguguggggugaggagccccucgcccccauucucagaagauuuucaugcucuccuggccauuucugacuguucuggagacugguucuguccuuguccccucaccagcucagugucucagaacucagagcaacucaagcccauaccugaacauuucugccgccaggugacacgaaggccuguuucccaaguguaccauucacuugcugucccagcuuucaggucuuccugggauucacacucggguuguccuggugcuuguacugacagcugcuuggggcugggccugagcugcuucaccuguaaagagacugaaugcacagggcaggguugagcuagguggcugcccagaucacuuccaguuguucgucuguucucauuagcagacggugaggugcagaccuuguugucuggguuguaauugcaguaauguccacaaggacuggagcaagaacucacaacaggauuuggaaucacagaggcaaaaaguagcaggugcagaaaccugaaugcaggacucugcaggcugguucccaggauggugaggguccuggagugaaagaugagugcucagaggaguaaggaggaggcaggagugaguagagugaggccgcugaggaguccgugaggacucuggguccuuguuuaaaaauuuuuucugcgcagaguaaugugauggagguuuuacuugaggaaaauuggauugacggcaggguacggccagucuggaggguugaaauaguguaggcacugggguaagagcaggaaccaggccaguggucauguagaaggggguuuacugaaauaugcuuccaaggaugggccacagauuggccagaggggaggaaagagaagagucagagaggagucuacgucuuaggauccuggcuaagggccuggaaaaauuauguuacuacugucagaaagagagggaagcauuuuccuaagagggaggaagaauggaaaguuccauuuguugacuuugagaucuaaguggauggucccuggaaguagcugcaagucagguacauggucugggaguuaaaauaauaucaugaaccauugcauuccugcuccaugugugcaguaaacuucaugaguguacaauccauuuugaagguggugaauguaaggcucagagagguuaauugauuuucccaugaucacacagcaauugagcagccagugcagcacucaaaacggguuucucacugcuaggucccuucucuuccacuacugugucuuucucccagugucucuguuuauacuuagguaucauuguauuuauuuuucccccagcuuuauauuuugaacucuuauuauacaaauuuucaaacauacagaaaagcuaagacuaguacagggaacacacuuaggucuuuaucuacauucaccaauuguuaacauuugccauauuuagcuguauaauguguguuuuguuuuggaaugauauggaaguuggaggcaucucaaucuuucauuuguaaauacuucagcauuugucuaacaaugacauucccaacauagcccaguagcauaauuucaucuaagaaaauaaacauaaauucgauauauguaacaucuagugcauagucagcuuuccccaagaucuaguugugguuugugcauugcauuuaguuuuaaucuuacuauucauaacaccucaaaacugaaaacuacccaaaugaacaacagucaaauuaauaaguagguugcagucuaucuguaucuguauaucuaucuauauauacauacacacacacacauacauauacucaguggaauacuguauaccaaugaaaaagaauaaacuacagcuucacaccaugauauaggugaacgucacaaacaugauauugaguagaagaagccagaaacaaugugugagacaauuaccugaaguucaagaacaggcaaaaaaguccagacaauguguucccguugguauaguauauauguauacuauauacguauaucauguauaugcuguauacguauaucucguauaugcuguauacguauaucucguauaugcuguauacguauaucguauaugcuguauacguauaucucguauaugcuguauauguauauuguauauacuguauacauguauaugcuguauauguauauacuguauauguauaguauauauaugcaggguauagugauggaggagauguaaaaggggcuucuagggacugguuauguucuguuuguugaacugaaugcuguuuacgugguuggguucguuaagaaaauucuuugcauaguguguggugacgcacaccuguaaucccagcacucagugaggcagaggcaggagggucacuugagcccaggaauucgagaccagccugggcaacauagugaggcccccaucuccacaaaaaggaaaaaaaggguaacgugacauuuuuuagccagcgcuggauccaaaaaaauaaaaauaaaaucuuugcguguacaaaacauaaauggcuuguacacuuuuauuuucaugaaaaguuuacaaaacaaaauccaagcugauaaguauguauuucauauuuuaucaaaccaggaggcauauacugucagguuuuuuuugucuucuagucaucuugccuaaaaggacucuuccgcuuuaagcaccacuuauuucuccuuuucuuuuuuucucuuugccucuuuguuccccaauaccuuuucuuuucuuuuuuucuccuccccuuucuguuacucuuccauaaacaccuguuccguuaauuuagagagaauauaagaaggaucagagugaggaugaaggaagggugaagcugagcauuucagcagcgucauggucucaguccugauaaauaugcuaccuaggggcguucuccugcaggagccucagugaagccugcuucauucauucagccagcaguuagcaagcaucuucccugagucaguccccugccaggcuccuaggagacccagaugaaugaaccugguuaggcagagggagcaugugggcaggacaggggacugagcaggcaccuggaaggucuggagagcugugugcugcccugugcuacagcagguguagaaucguuuggggaaggcgcaggacaucuggaugaauggaaacagcauuuccaacaaagucacauguaaauagguacagaauaauaaagugcuaguuaggugcacagugcugaagaggcccagaguaagagaauaaucguggugagugucuuagaggaaauuauugagcuacauuuuguaagaaguaaaggucuagauuagcagcaagauaagugggcgggcacuggaauuuggcagacuauucuguaaaaagacauggagguggaaauaaggaaaaagaaguaaggaaagccugaguugagguuguuggucaaaggaaaaaagagaaggaaccaugaaugggaccccugugaagcagaguucuaacauguaaauguccugcggcuaccacagaaucaaucuuuaucuccuccuguccuguaggcggugggagcaaggaaaaggaggcaaaacccccacaggaagaccugaaaggggcgcugguggcacugacaucagagagguuuggggaagccucucuccagggcccugggcucggaagggucugugagcaggagccugguggcccugcaggcagugcgccugggcuuccuccuccccagcacggugccaucccccugccugacgaagucaaaacccacagcuccuucuggaagccuuuccagugcccugagugugggaaaggauucagucggagcuccaaucucgucaggcaccagcgaacccacgaagagaagucuuauggcuguguggagugugggaagggcuuuacccugagagaauaccugaugaagcaccagagaacccaccugggaaagaggcccuacgugugcagcgagugcuggaaaaccuucagccagagacaccaccuggaggugcaccagcgcagccacacuggggagaagcccuacaagugcggggacugcuggaagagcuucagccgcaggcagcaccugcaggugcaccggaggacgcacaccggggagaagcccuacaccugcgaguguggcaagagcuucagcaggaaugccaaucuggcggugcaccggcgugcccacacuggcgagaagccauaugggugccaggugugcgggaagcgguucagcaaaggggagcggcugguccgacaccagagaauccauacaggggagaagcccuaccacuguccugccugcgggcgaagcuucaaccagagguccauccucaaccggcaccagaagacccagcaccgccaggagccgcuggugcagugagcauagcagguggcaggcagcaccaucauucaucuuucucacugcagggccuugcggggugcaaggugauggcugcaggaaagcacuggucccaucgccuucccacccauucgccaacgcgggaaaggcaaggccuggcuuacuuagagcuuccagagagcauagcugcuuccaucucuuacccaaguggugcuaaacaauuuuucuuccaauguuugagggaagcagucuccugcgguucaguucaggcugagauuuucuccuucaguggacugucugugucccccugccgaacaaagcugggaguaaaggcaaaaccuugacacguguugguagcugggaccucaucuuccugagggcucugucuugccugcagggucauagcucagacucuucccccacccccucucuuuuccauugaacaaacauuuauugaacauccucugagcaccuggccgugggaaugccguggugaaugagagacuagacgugaugccucuggggguugugcguuggggaugcaugcgacagcccaugacccgaggcauucucaggguaucugugcugugugcccgugagaacaucuucccaugaccacuccugcccuccugccccgugcuggaucuucccuccccagcugggaucugcucccaggcaacugugugaauuuuacauuauuuggagccucaucugugucaggcuauaacauucuauccucaucuguaaaacuuccccguccauuauuccuugcacuauaacaacugucaacacaccaacuauuaggaaguuaguauuuugcuauugaucacugaauaaacaucagaguauuuuaaaaaacaguucucuagaaagaacuguuauaauuaaaaugagucugaaagaugaacucuaguauuaaugcccuauauuugauggcacuuuauaguucauaaaauuaauuucaccccauucucauuggacccauuucccaaguauuuauugaggcccuguaacaaacaugucaggaacucuucugggugcuugagacacauccaugaauaaaauagggggagaagcuguugaccucguagagcuuaugucucguggauguaccugaucuucagaacccguggauauuccugcaaauccucugggccuguauucauugcuuugucagcaucuugcccugaaaugcauuugucaccuaccucuuguuacuaaauggucucugcccuccagacccuugucauccaaggcacuagggguccuggacacccacuggggaugaugagcugguagcgaccuguuuugcaugagugccaagucaggaaaaauaaagauauuuguaggcauuaaaaaaaaauacauuucuuuaaaaaugagaagaugcaauauuuguaaacuguugaagcuuccuuauugugccaucacuuaaggguuucauuucuguuuaaaguucuggaagcugcauaacuagcguggacugacugcugugucauugugcugugccuuugaacccuggcugagugagugaguuuguccuuuguugauaguguccuauaauugcaaaaugugguuugucuucugaugccucuuaauaccagauucuuuuacugagauuuuuuuuuuucauuuuccauuguaaauaagguaaaugguaaugacuaacacaaagcuguauuacucagcccacuuugaaacgugguuuuaucaccuguucuuguuaggcagcauggugucuaauuuuggcuuagcaaaugacgcuccuuggucuuccuggcucauuagcugugcccacgaggcugcacugacugggucguaaauguaucugagauguccacacggggcugcugcugcuccucuguaauacugagguccacaugcaaaaucagcuuuuuuucccccguaauuaucagagcagcuaggcagggcugacagccaggcagacucagugggaggcuucuggccugaguguggccuuccccagagggugguuuuccaaaggcagguggggacuggggaggccucggggggcugcuugucauuaccugaaucacagaugcucuuuugucauacacagccagcauuccucuggguuucagcaaguuggcauaucuuaagcuucagaaggagcugggccuugcugacuuuccuaucuggccucuucccuaucuccuguggggccaagagcuuaggacagugucucagaaaagccucuaaguaggggguuuuucccaugggauugugguagucugauuuuucauaucuauucaaauguuaagaaauauuuuguuuucuguauuuuucuauucuuuagaaauuuuuuuauaauagauaauuucaaaccuauauaaauaaauccuuauguauuuaucauuugacuuuauuauaaacucauaaucaaucuu

SEQ ID NO: 191577 - RNA, 9604 nt, Homo sapiens
gcaagagggcggaacgcgggacgccaggcacccuagcucccgacggacgcaguuuucaguugcacgggcgagcuccgggccggcugcggagcgacuccccgccgccaagugggcggcguggcugucgggaaagaagggcuggggccugccguucuuccucccgaguauccccuccagcuggacgaccccacgcugcagcacgggcuuccggcuucucuccucaguggccaauucgagggcacagcgggcuccggaggcgcggcggcaagccuaucccgccucccaaccacagccuccagcacccgagagaacggccgcccacagcacacguucuccggacaggagggcgaaggcccaagaccuggagaggugggcucgagggaaagaucugggucccaccacuacuuccuggagacgccggggaaagcaggccauccuucgagccacccaucucuucuccgauugguuaacugccuucuuauugcgcuccgcuggcuggugauugguugggaugcaccgucuaucaccugcuuccuugugagaaucuaggucucuaagggaagcguuacuugaggcucgguugggaagagguugguugggccucuugagcccacuuuauuuaucguaguggggaucgucccccggcgcgagcuuccgucgcaacggccgggaaagaaaccaguagcgggacggagggcggggguggcaagaaagucaagguuuagaaguaagccggagacgccuaacccugguaacauccgaaugggaacgggauaggaaggaaggccuuugagagaggaggcguaaacccaggaacagugacaguguaggacgaaaggccuaaguuuguugcggaagguaggggccuugcgggagguuuucgugaccuaauuguauggggaucuaauuuucuagaugugucuaacaaaauccacuggagaauuugcuuuggcuuugcagcagaguggggagacuaccacccguuccuggccuuuaaagaaacaguuuauugaauuauucaacucucuuuuauugcuucagaugggcagcucucaaaaaaggcacaaacaauugaaggauggauaccauggcauauguuaaaagcguguugaaaggaaaauaagguauucgcuuuguuuucauugugauuaacuguauaagaaaauuaccuuuaaggagaagcucaaguuuuaaauaauauuaggguaacuugauuuuaugauaggcuucaacuuguaaaauuauuuauuacaaaaauccuauuauugcuguaccuacgaaauaugcucuuugcuaauuauggucuuaaucugaagauagagaucuugaguuuuuaguaguguuaauucauauuugaguggauaauguuacuaggucauuuguucaaaaugacauaauaaaauaaccacagugaaaaaaauccuugaauuuguaauuuaguguuacaggugaaauugaauaguugcuuacuccaacaguauuuuagacuuguaggcuaauuucaccuuauauuuaaagcagcuugcuuauuaaauaccuaguguauuucgagaggcagaguugcacaguugcuucacugguagccuagccauuugagccuccagccucuacugagucaggugcuguauuacucauacccuuuagugacaugccagaaauugucgaggaauaguuuauuucaucugcagaacacccaaauuagcucuuaacagcagaccugguccuacccuggaaaacucuaaucaaggauuggggaugagauuugggcaucuagauuuuuaaaaauacccuuaagugaguuugagaaccauugcuuuagugugacuuacugaauagauguauuuaagaaauucuaaaauauuugugaaacaaacaucuuucucucuugauuuccauguaauuuaaaagugagcuucucaggagugacacuuaaauauaauccaaaaauagugguuucuuaggcaaagucaggaaguuucacuggcauucugaaacuccugggacuaaccauuccaggcuuaaggaugaggcuugauauggggugauacaaagugcucugaugcacuuucacaauccuugagccauacaugaugucuuguuuccuguuggguuucaaagucuuccugguaagcuuuaauaagagaccaccuuccaguuuguucaguagauauuaauuaggcuaaaugauuuucaccucaucaaagugcagugggggauaauauuacauucaugagccuuauuuuggaaagaauaccuugcugaaaacaaauguaaauuauaucaucccaguaucccuuugcucauuaagugaagaaugugcauaauucaagccuaaaauuuguaauuaaugugaaguacccagauccugaaacauaaaugaggacuucuggaucaacuuuuccagaucgucaacauggucaaaaaugagauaaucacuaugguauucaggcaugagcauugugugguaaacccaaauccagucugacuuaauggcuuuaggcaaagaaguaagugccaauuguguuguauuuccuagaagcuguuuuucauuuuauauguaagcuucucacugcaagauuuggcaaauacaguauuuggguaggggacaacauuuaaaaauuaagaaaaacugcaaguuaaaaauacaaagccaaaugugguccaugacuuaacaccuugaauguuguuuauauuguuugaacagaaagccaggaaucucaggaugaaucagucuagaucgagaucagaugguggcagugaagaaaccuuaccucaagaccauaaucaucaugaaaaugagagaagauggcagcaagagcgucuccacagagaagaggccuauuaucaguuuauuaaugaacucaaugaugaagauuaucggcuuaugagagaccauaaucuuuuaggcaccccugguaagagauggguaaaagaggaaacacccuuuuuucaucauuuagauggaaggauuucaagauaaggagaauugguauucuuuuuccuugcuucucuuuaugaaaauauaguauauuguuuuugugaguuuaagaacuuuuuaguauaauaaaguagaaaaucacuggcuucuguauuuuauaaggugaaaauaggggacauggagcacuauuauacaaaugccaaacuaagaaacagguuaauguacauaaugguguuaaguauuuacauauaugguccuauuuguaauuuuuauacaaauaaaauaugacuuaaaacccaauuugaacucauuugggguauuauaauuuauuuauucagcugaauuaauagcuccccccaaagcccaauguguuccauaaaguuuuuacaaaugaacuaauggaaauuuguauguuuauauauuguguguuuguauauugaugacccauauaaugaaguauuugggauaaaauucaaguaaauauuugaaguuuucucuauaaaugcucccuuaauuucuuuuuaacugacaaaaauccacaguuauagcuuauagauuccuaaguguaucaacuggcagcacuuuaccaacuauucaaauuaaaucuuauuuuaauaauuuuuaauaaaagauuaauaaaugaagcacaaccgaauugaugcacauuuguaccaguugaauauuuuuaacugucuucaauuuacagaacauaugaaaguaauaagacauuugucuucuauagguuacuaaagauuagucuuacccuucaugaggucucauaaaacuuaauucagaauucuuaaaugagcaguuuuucauuguuuuaggagaaauaacaucagaagaacugcaacagcgguuagauggcgucaaggaacaacuagcaucucagccugacuugagagauggaacgaauuacagagguacuauggaguccuuuccauaaggaacaggcuugauuggagcacuugcagaaaugaaauucuuagaccuuguauaguauguuugucuucaauuuuuuccaguuuuaaugugauacucauucagauaauauauauaugaguaguaaagcaguaugguuaagcaguauaggacagaggaaugaaugcaaagaugucuuaaacacacagauugccuucagagagcuuuauguaauaauauacaauuaaguuaauucccagcaugcuucuuuuuaaucuuggaauguacacauuacuuuuucuaaagugauauuacuuagcuucuaaaaauuuauauacagaaccguguagaaagacugaguuaggaaaccuguuuuuguuucuuuguucuguuugaugguuuacauauaaaaaguucuuauaaggaaaguacuauaaaagaacuucaaacuaaaugaaguauguagaguuaaaaggaaaagccacuuuuguguuccucuuaaccaguucuacuucccuccucagagguauuuauuaguaguuucacauauuauaucaaaaucauuguauuaguuaccaugaagucuauguaaaaaccccaaaaugcaauggcucaauaagcuagaaguuucuuacuuacguuaacaguccagggaaggaaauccucuuggaacccacucagcuaacagaaugauucuacaacugugcuguucaguacaguagcugcuagccacaugugacuauuuaaauggaaauuaauuaaaaucaaauuaaauuuaaaauuuagcucauucauacuagccacauucaggugcuuaauagucacauuuggcuaguggcuucuguauuggacagcacaaauacagaacauacucauuacuucagaaagauuuauggggcaucacugcuccaggguaccauuuguaugaucaagguaagucgcaaccauaucuagguucuagcugguaggaaggagguccacgcacuagcgugagaguaggauguaucgcuuacucucccauuccauucaugagaacuuagucucauggucacaccuaacugccaggcuguccacgagccaauuuccgaugcuuuuacaauggaagaagaguaggguagcuuugaguagguacuuggcaaacucuuucacaugcaccaucaucacuacacuuaaucaaauguuaaucaaagaaggaaguagcauuuaaaauaauucauguucaccugccuuuuacucauucuuuuuccaaacaaaugggaaguggacauuaacacauuuuauuauuuguguuuagauauguaaguuguacuauauagaugcaauaauuaauacugaucuuuugaauauguuucaguggaaaauguacucaucaaauauaaaauagcucaucaucucuggaauauggcucaguugcuguuuauuuuauuggcaucaacagcugauuaauagcuucaacuucagcauuuaaaaaagucuuacgagagagauugcaggaaugaaaugaaaucagaaugaugucauauaauagcuauuuuauuuauuuguuuauuuauuuuuugagacagaguccuguucugucacccaggcuguaguacaguggcacaaucuuggcucacugcaaccucugccucccggguucaagcaauucuccugccucagccuccugaguagcugggauuacaggcgcacgccaccaugccuggcuaauuucuuuguauuuuuaggagagacagguuuuuaccaugucagucaggcuggucucgaacuccugacuucaugaucugccugccuuggccucccaaagugcugggauuacaggugugagccaccgcgcccggccuauaauagcuauuuuugaguagaacaaacuuuaaaguugaaguuuguguaguuaauguguugaugcuuuuuauuaaguuuuguacuuuauauaauaucuacugguuauaaauggaaaauuuaagcuuggcacaguggcaguaucuuagucaaaaaaguuuaugggugacacauuucuaaauugauuaauugagcaauauuaauugaaagucugauuuauacuagauacugcuguagaggcuggagauguaacagugacuaaaacuacaaaaaucuuuguuuuccuggagcuuacguucuaaaugaauagaaaauguauuuuauuauguauaacagcuaacauuuaugggguggcuuuuuaugugccagauauuaugcuaauuauguuauauauagcgucuuauuuuauccucaggauaacccuaugagauugauucuauuauuaacuccaguuuauagacaaggaucagccauagagaccuuaaguaacuugccugguuucucagcuucacacaaagacaaauacaguaaugugguuuuaauguuauauucagaaacucacauuucuugauguguacauuuuuggcagcaccugagaaauaggaaaaauuucuaagauuacagaaauaccuaguugcaaaaaugacugaguuggcuuuuccagaaagauuccacaaauacaggacaaauuuuacauaaaguuugucuuuguauuuuauugauauuacuauauugauaaagcaauuuaaauguaaacuuuugguaguggacauguuucucauuugccuuaguauuuugcuaguaaugggcagauagaaaguaagaaugaggauuucuccauagcguugcauaaauaguauuuaaagcuuuguaacuauguaaauaguaauuuaauuuuuauaauaugcuuauaguagauauacuuuucuuuuagaaaguugucuuuuugccaucuuucauucauuaaaauccacagauguucuuuaauuuauuacaaacuuuguuuuucuuacaaguuuucaauaaagcuguaaggugugucuuaggaauugaucuuaaguugauuugcuuugcuuucuagacucagaagucccuagagaaaguucacaugaagauucucuucuagaaugguugaacaccuuucggcgcacaggaaaugcaacucgaaguggacaaaaugggaaccaaacuuggagagcugugagucgaacaaacccgaacaauggagaguuucgguuuaguuuggaaauccacguaaaucaugaaaauagaggauuugaaauucauggagaagauuauacagacauuccacuuucagauaguaacagagaucauacugcaaauaggcaacaaaggucaacuaguccuguggcuaggcgaacaagaagccaaaccucagugaauuucaaugguaguaguuccaacauuccaaggacuaggcuugcuucaagggggcaaaauccagcugaaggaucuuucucaacauugggaagguuaagaaauggaauugggggagcagcuggcauuccucgagcuaacgcuucacgcacuaauuucaguagucacacaaaccaaucaggugguagugaacucaggcaaagggaggggcaacgguuuggagcagcacauguuugggaaaauggggcuagaaguaauguuacagugaggaauacaaaccaaagauuagagccaauaagauuacgaucuacuuccaauagucgaagccguucaccaauucagagacagaguggcacuguuuaucauaauucccaaagggaaaguagaccaguacagcaaaccacuagaagaucuguuaggaggagagguagaacucgagucuuuuuagagcaagauagagaacgagaacgcagagguacugcauauaccccauucucuaauucaaggcuugugucaagaauaacaguagaagaaggagaagaauccagcagauccucaacugcuguacgacgacauccaacaaucacacuggaccuucaagugagaaggauccguccuggagaaaauagagaucgggauaguauugcaaauagaacucgauccagaguagggcuagcagaaaauacagucacuauugaaagcaauagugggggcuuucgccgaaccauuucucguuuagagcggucagguauucgaaccuauguuaguaccauaacaguuccucuucguaggauuucugagaaugagcuuguugagccaucaucaguggcucuucggucaauuuuaaggcagaucaugacuggguuuggagaacugaguucucuaauggaggccgauucugagucagaacuucaaagaaauggccagcauuuaccagacaugcacucagaacugaguaacuuagguacagauaacaacaggagccagcacagggaagguuccucucaagacaggcaggcccaaggagacagcacugaaaugcauggugaaaacgagaccacccagccucauacucgaaacagugacaguagggguggcaggcaguugcgaaauccaaacaauuuaguugaaacuggaacacuacccauucuucgccuugcucacuuuuuuuuacuaaaugaaagugaugaugaugaucgaauacgugguuuaaccaaagagcagauugacaaucuuuccaccaggcacuaugagcauaacaguauugauagugaacuagguaaaaucuguaguguuuguauuagugacuauguaacuggaaacaagcucaggcaauuaccuugcaugcaugaauuucacauucauuguauugaccgauggcucucagagaauugcacuuguccgaucugucggcagccuguuuuagggucuaacauagcaaacaauggguaaggugaugggaucuacucaaauacuguuuuuuaguagaacugaauguucaagcauuguuuugcugaguuauuugugauuagcuaaccaggaugaaaaauaacagauuauauauaguuugaacuauuuuucgugugcuuuuuuaaacuuguuaaaaagaaauuuauauaaaauuuaaaauacaaauguuaaauuauccagaaauacagaauaguuaauauugcuagaaccaaauaaccucuaaaauguuuuuauuuugguaauuuugucaugcuaagcacuuuuguaucugcacaauucaguagguuaagaaucaaucuucuuuuucuuaauaguacagcagacuuuagcuucaaguuucauaggcuuaguacuuauaucuagacauuugugucuaaauaagcuuuucauuaacuuuuuauuuuaaggacaguaucuuuucaugaaagaguauuuggcugaauguuugcuauauauauguuacuugaaauguuaaauuuaauaugcagcauaccauagguguauauauagguauauaauuuuaagguuaaaauauucagucuacaaguuugguucuuauuuaagcuuuugggcuaauacugcauauggcacaauguuuaauauuggcaaguucaucucagagaaaggggauucagauauaauuuuaaaguagagauaauuuacugaagcgucucugacaaucuaacuuauuagacagcaagcaauauauaauacugaaaaaguauucagaaauggaaaauuuacaucauauagguuauuuaacuuguguucagccuuuuuguaacuuuuuugaaagugcaaacaauucuuuggauuauuaaauaagguauacaguaugcaugguuucucaaauuuaguuuuaaaaucuaaaagucuauaaagaaucagaugcauaggcaauauguuaaguucacuuggaggcuaaaaaucuccagugaaaacaaaacgaaaaccuuuaagagaauguagaguuuauauaaacacaaaguaugcauugaagaucuguuucuaccaauaaacauuaaaacaaagacugua

SEQ ID NO: 191578 - RNA, 14559 nt, Homo sapiens
aguacgucgcuacgucccgucucuagcccuggcgcuccgccggucccguucugcaggugggcgucgccgccgacuuaccaacaaccgggucgggggcucccggaagugcucuugcggcuuacugccuggcacagguggggcagagcgagccaggcgaagggcgccugcgcaggacaugcuggacaaaugcguuguucuugcugccugcuguugcgggaggaggccuuaugggggaaggucgcgaagugacugggauuuuuuuucucauuugucauuuagugggcuccguggcuuaagacuugaaccaaguaaacgaaguucucuuacugagaagucucaguuucaaguacguguugugaaaggccuaagucuuagaaaaguagaggauggagagaagaaucugaaaaucgacuacuauucauucugucaggcacaacacaguaacgaauaaguccauuuuguuccugcuucguagaguuuacggucuagugauggagaacagcagugcuaagaucaucacaaaacuguaauuguaaugaauguuuuaaaggaaaggucaacuggacuguagaagcauucaguguuaagcucaguaaauugggggagggaugggagaacuggcuuaguuuggaagguaaucagaagaaugcgcuaaggaucuggcguuuccuaaaccaaggacgagaguacuguauuucaaaaaccgaauggccaguguggccuaggcauaaagaagaaacuggagaggugggaagggccuuuuggccuggcgaagguguagaucuuuaaucucggggcaguuuuauuuaaggugaggaagguccuggguguagugaccgcagugcagugggaacugguugccagggcucaagccgaguuaggagacuggcaggaauccaaacgagguggucgauguuuuaaacugacgguggugacaguggauacggagaggacuggauggauucgagugggguuuaggaaaugaagucgaugaggcuugguguuggguugacugggaaaguggaggcgucaaaggugucuuggaggugacuggagguuguggauggguagugaucccaucacuagaguucuggaagaagacuaacauaggauuaacauaggagaauaaguuaaaaaaaaauuuuuuuugagagucucacccuguugccuaggcuggaugcuuaggcuggagugcggugcacgaucucagcucauugcaaccucugcuucccggguucaagugauucuccugccucagccucccaaguagcugggaauacaggcucacgccaccaggcccggcuaguuuuuuuguauuuuuaguagagaugggguuucaccaugucggccaggcuggucuugaacuucugaccucaagugaucugccuuccucagccuccccaaagugcugggauuacaggcgugagccaccgugcccggccguaaguccaguuuuuaauacagagucuuuagcucuggguuuaaaagcuuuuuaaaacauaugguuauuauuucaauuuaauagcuaaagaaauaagguuaaauaguuggccaaagauauaauguuggcuuuuuccaguguucuaaaugggaguucuagcacguaaacagcucagccucauuauggagaguacacuuugugcucccuauggaagagcaaaaccagagccaagggaggggagcaugaaggcccaguaacgguagcgcaggcccucugggauuaaggcugcacugcucaggccagaauggggcaacugggacaguuugcaggcagaagcaaggacuuuaugaaacuucuuuggaagguguaaaagaguucuuagagucaugagaauuggcaaaauuaauuucacaaauauuuaguccgcuagaaucuaugcaacuuugauccaaucucccaggaaagaacagauaacaguaugagcuugugaauaucagcuguaugagaaaagcagugagugaacaaauaauagaaguuauuuucgucucuucaguccacaugauuucaaaugcaugcaagcaauuuuuuauaggacgagaaugcccacccacccaccccucauaucuacuaaaccacauauuuaaaucauguuccaggaaguuucccugcaaauauuuuaucaguacuuccgguagaaugcaaaauaaugaauuauacagggaauacagcuguccuuuggagcaguaauaauugucuuuuuuuugguacaagaauguucacagcagcuauucauaagagccaaaaauaaauaaauaaauaaagggaacagccuagguguucauuaacgaaaacuagauuuaaaaacugcgauauauucauauacuuggaggacacuucuuagaaauaaaaaggaacaagguaaugauccguacaacgugaaugaaucucgaaacaugcugagaugucuuacaacaaagaguagauauuguuugguuccauuuauaugaagucuuaggacagacugaugggaaaaaaucagaacaauaguugccucuuggggauggagauugacuuggaaauggcaagagggaacuuccugggauaauggugauguucugucgauaggaguuuugguuacaaagguauaugcacuugucaaaacucagauaaagucugaguaaucaucgaauuaaaaauggauaucauacuauaaaguuaugcauuauaaguaauugacauuaagauaauugguuuuuagaauauuguggcugucucggagaguauaguugugggagugagugcagcaaaugcaacaggauuaucauaagaacguaagcguuuguuucuauuuugaguuagucuccuggccucuucagccuaguguuguuuaccucacagaggcaucagagauuuucaucagagaacauggcuuccuauuuuuauucaacuuugaaagguuagggguagucucaggcauccuagcucaaacuacccuugaccccacuuauaguguuuucuuacucuuuuucuuaaaguucaucuuuuuuuuuuuuuuuuuggccuaacccacugguucugaacaggauagggaagaggaaacaucuguguuuugaaaagcauccccaggugaugccgacaggccgugguuucugagaaacaccaccccauuguagaccaguuaacuuuuaaccguucacuagcaaaaaauuguacaaguucugccucaaacugaaaccaucaccauuuguuuuauucuucuaaaauuuuuauuucaguagcuuuuggacugcaagugguuuuucauuacauggacgaauuauauaguggugaauucugagauuuuagugcaccaucacccgaaucguauacauuguaccuaauguguacuuuuuuuaugccagccuccuucccauccgcccccaucaccauuuaugaugagacuuuuagaccugaguuuaaggaaaacuaaaugaagaaauaaaggcacuaugcauuacaaaaaaaucagaauuuuaaguuuauaaaguuccuuauuuaugggucacuuagauauaggcuugaaacgaauaaagggaauauuuuuuaaaauuauguacaaagccagaaugucaauguauuaaauuacagugaaauuuagaacuuacacagacuagaauaguuacauuggcauuaccagugaaccauuccucccucuaggcuauugauuuguucuuuaaaaauguauuaauuauugaacacccguauaaccauaaccuagauuuagcaaaugcugccguaagugcauuguuuauauuuucugcuguaugguuucaaagcaagugauagaugucaugacacuauccuaaauacuucagcauuuguuucuuaagaauuccauuuucacaccuaagaaaauuaacaggcgggugccguggcucacgcccguaaucccaacacuucaggaggccaaggcagguggaucauuugaggucaggagaucgagaccagccuggccaacaugguaaaaccccaucucuacuaaaaauacaaaaauuagccaggcgguaguggugcacaccuguaaucccggcuacuugggaggcugaagcaggagaaucacuugaaccugggaggcggagguugcagugagccgagauugccccacugcacuccagucugggugacagagugagaaccugucucaaaaaaaaaagaaaaaagaaaauuaacaauacgucucuaauaguaucuaauaccuagucccuauucagauuuuccccucauucccaacauuucuuuucagcaaaauuaugucuccuugauuuuuuuuuucacucaagaauagcuucccucuucccuuuucauucccaauggcauuggcuuuuuuagacacuaaccaggugucuuguuccaucuggauuugucagauuguuuccuuguggcaucuucuauuguuucucugagucuggcccuuguauccccuggaaacuggaagcuagacccugcaucagguucaggucaaaccuuuuuggcaaagcugcuuaauagaaggugccaugcacuuuggguagcuucccauccagagauguggcaaggauggcagguuguuccacuguuggagaugcugagucugacguuggcuuaggaugacagacagcugucuacccucagcagagugugcuuuucccucucagucugaaaguaaucuguuugugacccuuuggcaucagcucucuugcauccugccugaaucaguaguuucguugggguuggaaaaauggugauuuucuuuuuuuuuuuuugaaacagggucuugcucuguuguccagacuggagugcaguggugugaucagagcucacugcagccucaaccuccugggcucaagugaaccuccuuccucagccuccccaguagcugggaguacaguugcgugucaacacaccuggcuaauuuauuuuuuguagagacugggucuugcugugugucccgggcuggucucaaacuccuggccuuaagugauccucucgccuuggccucccaaagugcugggauuacaggugugagacaucgugcguggcaugauuuucuaauuacuuuuacuuuucuuuuguguuuauuagcugucauucuucucuacagaagagcuucuccucaucaacuggggaugauuacaguucuuccuaaaaaagguaggauaaaugcucaguucuuuuuauuuaauuagcaauuuucaaaguaaaaaaucaauauaauagucccaugcaguuguggcaaauuaucauuuucauagauuuuuguauauucaguauauugaaaugaaugacagugauuaugccuuacuguuuaaauuacaccaaaauugaccagugggagucucuucaugcugccaaacuguaaaugacauguaaacaaacaaaaucauaauaccaucauggaaaucugaaagcuaaauauuugaugaaauaaaggaacguuuuuuaauugggauaauauugugaauacuaaaaagauuaaggaguaccucuuagagauacauacuauuuccugaaaaaguaggauuuacuuugaaagcauuccuggaugguuggggggagauaguugagggguaaagaugaaacccagcugcuguuuauuauccaguucuuucuguacaagguuaaaaaguucccuaauaaaaaguuuuuaaauuaugaauuuauguugauagcugcaauuuaaauguaauauuacagguuguuuuaacuuuguauuuauauuuuuaucuauaagggccuguuuugaagaaacguauauuuucaauuuugcugauuuaaagccaguauugaguuaguauuaaagcuuaauugcaaugaauugcauuguuugcuguauacaucaauaaaaauugaaguuucuuaaaaauuuaaacuaguggcaaagaacuuuaaaaguuauauacuuccaguguuuuucuuuuuuuuuucguuuuuuuugagacagagucucgcucugucgcccaggcuggagugcaguggcgcaaucucgcucacugcuagcuccgccucccggguucacgccauucuccugccucagccucccgaguagccgggacuacaggcgcccgccaccacgcccagcuaauuuuuauuuuauuuuuuaguagagacaggguuucacuguguuagccaggauggucucgaucuccugaccuugugauccgcccaccucagccucccaaagugcugggguuacaggcgugagccacugcacccggcccuacuuccaguguuuuucuauucuuucccuuuccuuuguuuccuucuuggaaaguguuuuuaaagcuuuuuuaaaaaaccuacgucauuuuucugaaauagucuuuauuuuguaaauaaaauuuauuuucaaguauaaaaauaacacuuauaaaaaaacuugagaaauacuggcaauuaggaaaaauaggggaaugaauugcuuuugucuucaacauuuuuauaaauuuuuuucaucuuuuccuauaucuaguuauuuuguuugcuuguuugaaaaaaaucaaauuuugaaauuuuuuauauuuuaauauguugauaauuuauuaaacaaggcacuuuagcucuuauucauaacuacuaagggaaaaagauagccaguacugaguuaguauuaaagcuuaauugcagugaacuguuuugucuacuguauauaucaagaauauuagaauuuauaucuaucuauuuaguaacaugauuuuacaugugauaacuucuacaucauugucgcuaauacagacuuuggaaagaaacaacacugauuuuagacauaaaguuuauagagcaggcuugugagcaggaacuuaagaguccccuagcagaauaccuagugacauuugggacuggaugcugcugcuaguuuucugauaagugaaaaaaaaaucuucugugaucuuuucagauuuuucuucuuuuuugguuugggggcuuccuccauucacaaaagaucugacuuuuuauuaaacaguaugucagugauuuaaaaucacuuugcucccaccuuagagccuuuacagcaucuacagcuggagccaccagcuggguaauaaccauaaaucaaugcaugucauacacuguggauggagcaucuggccacagauacucaccauuacugacgggcaucugaaaugccagcuagaaaugugaaggguguaguuuguaggcauucgugacacauccgaagguguagagguuaaaugccagcagcccugccauagcuccuuggcuguuuccuucggcccgugcauucauucgacaugugcaugcugagccaggcucugagcuguagugccggggaacacagcagugaacaaaauggacaaaguccauguucucaugaagcuuucauuccagugaggaaagauuaugaacauauaugcaaauaaauauagaauguguccagcagugaugaaugcaguaaaguuuuuaaaaggcaagguaauggguuugagaguguuggggugugcucuuuuauggaagggucagggaagggcucgcugaguagguagcguuugagcagagacgagguaaaugaaccaugaggcuaucugagggaagaguguugcagggagagagaacuucugggugccaggacccagaggagggguguguucacuguucacaaggaacagcaaggaggcuggaacagagugagccagaagaaguacggucggcacaggccagugggcaugguagagagcuuagcuuuuacuuggagugagauacuagccaggggagggugugggcagaggaggaacgugaucugacuuacgcauuuuuaaggauugcucugugugcccuagcaguaauaaacuccaggcugugagggcagaggcaggaagagcagucgggaagcuguuacugugaugcgguuuuacugugaugcaguugagcggcgcggcgguuugggagugggaugauagcaguagagaaggugagaagugguuauacugguugaacgguagguuuugcggauggguugcugagagaaaauaaagagucaaggauaacguugguauuuuuggccugagcaaccagaagaauguguugcaauuacaugagacagggaagacugagggaggagcaaguuuugcauggaaggcaaagcauugaacuuugaacacguuaauccucaaugacuauuacauaucuaaguggagagguuggguaggcgguuaacccuacagguguggaacucaagagaagagacuggcaccagagcuauaaauuagaguguuggguguuaccaaacuagguaaggaggguguugagaauaugcauguccaucacuuucuguugaauuuaccauauuuuuuugcauaucacucuugaacaugacaggugagagauaaguggguuguacagcccagugggcucaaagccagggaccagagggaacuuccaguuuuaaacaccccaggagauucugggaccauucuuugagaagcacccugaagacaccuucuguuuuccucuuucaucuuugacaagucacaccucuccaaguuugugauucucuaaugauuccuagcaugcccuagaugagaugaauggguccucucagcacucuuucagccuguacuucuaagauuuaccaaauacaugaauggaaggacagaaaagcaauuaaaaaaucaaugugccauuuguaagugcuucaaauucagucucauaaccaugaaguaaaaccacugucaccauacaugccucuguuaacauuugguaguaauuaacaccugccuuaccuugagaaugaucuuuauaguuuaugagguuagcacuuugauuuaugucacaguguuuucugacaggcucaguuauucuugcagugggcuggcuuccuuccuggagaggucccuuucccauaguguguuccuaucugcuauauaccaucagauguauugaaaaauuguuaacaguuaauuauauuagaaguuuaucaauugguguuuaugaaucaccaagcauuuuauguacugcauccucauaaauaaagcccuaagaugacacucgcuuuuggaguuggcacuacaagaugcaugagaaauacaguugauccuagaacaacacagguuugaacugcaugggguccacauauauguggauuuuccuccaccuuugccaccccugagagaagaccaaccccuccucuugcuccuccuccucagccuacuugaugugaagacaaugaggaugaagaccuuuauggugauccacuuccacuuaauaguaaauauauuuucucuucuuuaugauuuucuuaaugacauuucuuuucucuagcuugcuguauuguaagaauacaguauauaauacauauggcauacaaaauauguguuaaucaacugcuuauguuauucauaaggcuuucagucaacaguaagcuauuaguaaguuuuugaggagucaaaguuauacacagauuuucaacugcacagggggucuguuucccuaacucccaaguuguucaggggucaacuaaguagucaaaugagaucauguguacagaaaaaaaaaaaaagugaaaccaaaaugcuauguaaaucugguuuauucuaauagccacuugucuuggggacaguaucaccaugaguuagucuggccagagucaccugcuaguccgcuuuaucaguguagacuuccuguguguggaucugaaagucuagagaacagcauuucccucacacuugcaguuacagccuccacaaccucacacacacccugccauguaccacaaugucagaccaagggaauaagugauugaauuuuaaugaacucuucuuacuacuuucuuaggauggcugcucuuuuucuaaagagguuaacacuacaaacuguaaagucugaaaauaguugcauuagauguuuugguaaacacauccugcaaaagacagcaccagcacaguuguccccuauugcuucugccccaagacucuccuuccuaauucaugcaaaagccuuuaguaccgcugaagacacccagaaugaaggaaaaaagacaaaaaagaauaaaacagcuuuuaguaacguuggaagaaaaauuagucagcgaguuauucacuuauuugaugagaagggcaaugauuugggaaacaugcaccgagcaaaugugauuagacuuauggaugagcgagaccugcgacugguucaaaggaacaccagcacagaaccugcagaguaucagcucaugacaggauugcagauccuccaggagcggcagaggcugagggagauggagaaggcgaaccccaaaacugguagguauuuugcuguuggcucccugaauccuuuaagagcuacaaaucagcaguuuaaauucuagcauuugucaaggugccugugacaagagggaaaugagaaacuagaaaauucaugauucaaccaccauucccagugucugucuuuccuccuuuauccugcacuuacuccuguucccuuuuuuucacuguuuuuccacaauacccugcccauuaucucuucccuuuaaaccuguguaaaaugugggagaaaccaggcaaacaaaccaaagugaagagaacucuuuccccuguccuguggccuucucccaaugccgcagcaagcugaguagccgauggggugaaacagagugagauuaggagggguacauucaaguucccugcccucugccgggccacucauuuaaccucccuccuuuuguuuuucuuccccuucuucaacucuaaaguggagguguuugguuaauuaucuggaagcaccuuuuuauuuuuuugagaugagucucugccugccgcccaggcuggagugcaguggugcgaugugugcucacugcaaccuucgccucccaggcucaagcgauucuccugccuuagccuccccaguggcugggauuacaggcgcccgccaccacgcccggcuaauuuuuguauuuuuaauagagaggggguuucaccauguuggccaggcuggucuugaacuccuggccuuaagugaucugcccuccucggccucccaaagugcugggauuacaggcgugauccacugcgccuagccuggaagcaccuuuucgacucugaagugauucacagagcaucucccaugccaaagcauuguguugcaauaucaguagcaacacucuuagauauacaaccagucacuugacgaggcacuugucauuuaagccucacagaagucaggaauuggauauuaagcaaagauguuuguuuuucauaguuccuaaaaagugccaaucauuaugaaaguucaauggauggcgcacggggacaggcaucagaugacugcucccagcacugcaucgugagguugugugccuucagaaaaccacauguuaucugcggcucaguuuuguaaugccacauuuaacaaggauguugacuggaaaacaauauucagaagagaccaaccagggaggauaaugacgucaaacuaugucacuuaaaaaaaaaaaggucacugggcgugguggcucacgucuguaaucccagcacuuugggaggccaaggcagguggauggcuugagcucaggaauucaauaccagccugggcaauauagcaaaaccccaucucuacaaaaaauuuuaaaauuagcaagguguaguggugcaaaccugugaucccagcuacuugggaggcugaggugggaggaucacuugagccuaggaggcaaaggcugcagugaagaaccaugaucaugccacugcacuucagccugggugacagagcgagacccuguguuuaaaaaaaaaaaaaaaaaaaaaaaaaacagucuugcucuguugcccaggcuggagugcuguggugugauuucggcucacugcagccuccaucuccugggauccagcaauccucccaccucugccucccacacagcugggaccacaggugcacaccaccaugccuggccuuuuuuuuuuuuuuuuuuuuuuguagagauggggucucgcuauguugcucaggucuugaacuccugagcuccaacgaucugccugcuucagccucccaaagugcugggauuauaggcgugagccagcacaccuggcccccaaucuuuaugaugaacccuggugcauacucuagggucuaugaaccuaaauggaucaaacugcucagcagcaguguaugcaguuucucuaccuccucccucauuugucauuuuaauggugagaaauuaauguguauuucacuuuuuucuucugugaauugcguguuuauauuccuuuauuuuucuacguagaugguuuuucuccgauuuauaggguucucuguuguguaugauggaaaaaaccguaucccaguuagauuuuucauuuugccuuuuuuucuuaaugaguuccauccccuauccugagaucacaaaccauucugucuuuucuucuguuuguuuuaaaguuguauuuuucaccuguagaacauuaguauaccuggggagaccuaacuuuuugucaucuauaaacuucucaauugucccaacaccuuuauugaguggccgguuccuucucuauaauuuuccaguaggcaggauuucuggagacagagggcaugaacacaggauguagggacccuuaccuguccaacagucuggcugaccccuuauagcaaggagagcaucucaaaaggaguggguagugcacucccagaugccaacccacagcugauagauaaggauguuaagugcaccaugaagccaaacuugauccuuuaaacgacuaucuuuugguguucuuucaacaaacgaugguuaacaauaaauggaagcauuucagauuuuaaguacccuuccagggcagguaaaaaauugguaccuuuauguguaucuuccccauuugaaaagacauuuacuggucugugaaacugaaagccagaugagaagauugucagguggcaaccuaggauuuuaugaugggcauguugggaaguucaggguucacaguggacuagucaguaguccuugcacccuaucuguuucaaaccaggaccaacccugagaaaggaacugauuuugucuucaaauauuggacaacaugauuuggacacaaagacuaaacagauucagcaguggauuaagaaaaaacaccuaguccagauuaccauaaagaaaggaaaaaauguagacgugucagaaaaugaaaugguaaguaaagaagguacaagccacugcuugugcuuugggucuucugaucuaaaaauacaauuguaggccaggcgcgguggcucacgccuguaaucccagcauuuugggaggccaaggugggcggaucacgagaucaggagauugagaccaaccuggcuaacauggugaaaccccgucucuacuaaaaauacaaaaaauuagccaggcgugguggcgggcaccuguagucccagcuacuggggaagcugaggcaggagaauggcgugaacccgggaggcggagcuugcagugagccgagaucgcgccacugcacuccagccugggugacagagcaagacuccgucucaaaaaaaaaaaaaaaaaaaaaaaauuguagaaaaucugaaauauaaagacaaagugacugguaauucuuccacccagugauguuaacagcuuucuaguuugcuuuucaaaacuaagcauacuguagauauaguuuccauuacagcguauuuugccauaugaacacauuauuccuuaaaagcaauauacuauuguuuuauaaauuguagaauaacccuuaaacaggaaaauuagaaacuuuauagauuuuuuguuucuucuuuguacuuauaggggcauuaauuacguagacugucuucuagaaaguguguaguuuccaaucccauaaguuuauggaauaccuauuuugcuuuuuuuuuuuaaaaguuagauaacuuuaucauccacuaaggguauccuuaguaauccagcuccacaguagagucacuuaagcauaggucgcaacccagcugaugcagaauuucuugagcccagguauccauuuguuucagucacugagagagacucuguuaggggcaauagagagugcugagaacugcucggcugacaccuuggggaugaggagguauuuugccaaugcccaaacccagugcuuucuguuugugggagaggguaaugcugagccaaacguagccucuucgugccaugacgaaguggagauuuaaaauuaggaagcauucagcaugucaguuuaguuacaugguguuauuguacagauuucagucaacuuaaccagauacguaugaacugauuagcuaaucacuuaaccgacagcagcaauucaagggugccaguuuuugugaauguucaagcagaacauuagaaagcaccaaagccucugauuuuaaauuaaucuuuggcuguuucccuuuuuuaggaggagauauuucaucaaauacuccagacuaugccuggaauagcuacauucucaucuaggccacaagcuguucaaggaggaaaagcuuuaauguguguucuucgugcuuucagcaaaaaugaggagaaggcauauaaagaaacucaagagacccaggaaagagacacuuugaacaaagaccauggaaaugauaaggaaucaaauguucugcaucaguaauuuuaauaaagaaaagcaugcucugagagaaagcuc

SEQ ID NO: 191579 - RNA, 156833 nt, Homo sapiens
cuccccgggcggcuccggcucccgcagcgggacagacccacccgcccaggcuuuuauccggcaccggcagcgucuuccuuuccucccccgucuauggugguggcggcggcggcuccucgggcggcggcggaagacgaggcugcggcguugccaugaacaguggcggcggccucccgccccccucggccgccgccuccccuuccuccuccucgcuggcggcggcgguggcggugguggccccgccgggggucggggguguccccggcggggcggcgguaggagugaagcugaaguacugccgcuacuacgcuaaggauaagacuugcuucuacggggaggagugucaguuccugcaugaggacccugccgccggggcugccccgggccucggccuccauagcaacagcgucccccuggcucuggcuggugcacccguggccggcuuuccgccgggagccgucgcgggcgggggagcugggccgccccccgggcccaagaagccggaccugggggacccggggaccggagccgcagccggcggaggaggcaguagcgggggacucgauggaccgcggcuggcaagugaguguuuuucgggcggggcgggccgcggcggcggagggcaggccugggccggaugaggcccugcugccgacgggagcugagcacggcccgcgggcucccccccucaccucccaaggcggucugagaggccuaggccgggccugagcccuccuuccuucuuccugcuuccccuccccacugccuucggcaagucggagagcgcggggagguuggguucccgggaacgugggugggaggacuggggugaugugaagggggggcggggaggaagggggaugggcuguggcgugcggagugugagaaagggggugucguuuccgggggguguggaaaggggcuggguuugcaggcacauguguuuugcguguccuuguggaguggcgucugcagaguguugagguucccuaguggggagggguguguuuguguguguguguguguguguguguguguguguguguagggggcgggaggugaggggcgggcuuaaggcuucguggaguagguugaaagaacggaaaaaguuuguagaaggcuugcgggagaaagguuuugcaggcaggaaaugcuuucuaaggauuaggagggagcggacugucgcguucaaagugugcucagguuuaaucgagaguuuagaguagggauuucacaaagacgcauuucaucugaguuucccugaaagcuagaauaaguuugcuggugucagcugggauccugucuucuauagcuuuguaucaagcaaacucagcauugugucuugaaugcaugucaugugcagccugcguuuaugugcgacugagcacuuggguggggacaucuuaaggcuguuuauauuucuuuuucauguguuguuguuguuguuguuguuguuguuuuggagagagucucgcccugucgcucaggcuggagugcaguugcgcgaucucagcucacugcaaccuccgccucccgaguucaagcgauucuguugccucugccuacggaguagcugggacuacaggcgcgcgccaccacggccagauaauuuuuuguaguuuuaguugagauaguagucucguuguguuggccaggcuggucucaaacugcuggccucaagugaucuguccuccucagccucucaguguguuguuaucuauugaccugaagcuuguuaguuguuaguggaguuuacaauugaaugugagcguaaucuguuagagaauguugccuuuacgaauagagccggugccagaugucccuguuuuguuucuuaguauauugagcguuucuaaaccaaauaggaguccuacuuucuugggaauucuggagaacuagaucuuaaaauaaucugauaggcaguucaauuuguacaugagaacauuuugucuuuuucuuaaacacuguuaaugaaccugauaggaaguuuuagcauuuaauuggucuaugaggauuauuuaauaucuuccccgggguuuugcuuucuugcuuuuucuuucgagacgggaucuuccuauguugcccaagcuggccuggaacuccugggcucaagcgaucuuccugccugggccucccaaagugcugggauuacaggagugaggcaccaugcugggccaaguguuguucuguucuguucuuuucuccuuucucucuucuuucuuuuucuuuuauagaaguguuucauuuguugugaugggcuugacuuuaaugaagauauauuugcuaaggcugauaaugcuaagaaaauuaauuuuguaaauucagauguuuuguaaaacaaaugguuacuuauggguggaauuuuaucacuuucgagcaucaacuuugcauuuucagguuaaaguuuugcuggaugugugagucgugacucaguaguaauguuugauuaguaaccaaugacacugaacaauaguuuucuuacugacagaaagagacacuuuuuuuuuuuuuuuuuuugagacggaggcuugcuugucguccaggcugaagugcaguggugcgaucucggcucacagcaaccuccaccucccagguucaagcaauucuccugccucagccucccaaguagcuggguuuuacaggcaugcgccaccacgaccggcuuauuuuuguauuuuuaguagagacgggguuucgccauguuggccaggugggucucgaacuccugaccucaggugaucgucccgccucggccucccaaagugcugggauuacaggugugagccacugugcuggccagaaagaggcacuuuuuaaaaugcugguguuagacuucauaggugaucuuucuaggauucucuuuuuaaaaaaaacuuuuaaaguuuuauuuaucuauuaaucuuauuccugacagacagcucugacgaucauucuaggauuuucuuuuucuuuuuuucuuuuuuuuuuuuuuuuuuuuuugagacggaguuucacucuuguuuacgaggcuggagugcaaucuagugaucucggcucaccgcaaccucugccucccggguucaagagauucuccugccucagacucccuaguagcugggauuacaggcaggcaccaccacgcucagcuaauauuguaguuuuaguagacacgggguuucuccauguuggucaggcuggucucaaacuccugaucucaggugauccgccugccucggccuccuagggauuacuggcgggagccaccgcaccuggccgaggauuuucuaauuaacacacaauagguagaagggcugagacuugaaagaggacaggauguaagcagaugaagaugggaggggaagguaaguacccuuaagguggaggaaaaaauauuagcaguggcucaaaggugggacaucuuaggaaaauaacugagauauagggacucgagaggacaggcaguuaaugcugaaaagguauuuuaaaauuaauacuuugucacuuguuaguaaaaguugucugauuaaauaguugauuuauguauuuagauucugugguguuugcuuuagcuugucuggcugaagccuaaggcuccucuuuucugugauaggcuucuugguaucucucaguaauuccuuauggauggagauuucuucauaaggaaucacaaccuagguauuacugagagauaccaaggagugggaaauaauguugcucaggaaucaggaaaaaagguuguguugguaauuguauggcuuuuuugaguuuuuacacuuauuguucauuuuuuagacugcuuucuaccuuuuacuguauucucauucaguguguuuugagacaguauugauccguuuauuuuauuuugaagagaugaugucuugcuguguuguccaggcugguuucgaacuccugggcucuagcaaucuccugccuugacuucucaaaguacugggauuauaggugugagcuaccacaucuggccuucauugguuaauuaugugugugaggcaguuaaaauagauggcaauuuuuuuuuuuuuuuuuuugagacagggaccacaggcacuggcuaccaagcaccucuaauuauuuuguauuuuugguagagaugagguuuccccauguugcccaggccggucucaaacuucugggcucaaagcgaucugccuacccugugagccaccauauauaccauaauuuaguguuuuuaauuucuauguuuguggguuuugauugaaucauuugacaacaaaagaaacaaaagauuuaauauagaaguacaaauuucugguuucccuuuaaggaugucucuuaccuguguuggaauuagagcuguugauagagcauaauucucuccauuuugacucauucccuaacuggaugacuuuuauaucuaggcauuugagguuuugacucuaacuuuagcacuucacauuugcagaauuguuuuuguuuuguugguguuucagauaguguuaaaaccuuggaggugggugcaugagaaaacuuuaucuuuauuuugcagccauuggaaaacugaagcacaaaggcuuuuucuuaauacacuuaguugcaaugauguuucaaccuuauaaggaaacugcaauuugauuuuuuguuuuuguuuuuguuuuuguuuuuuuugaggaggggguugggaguucuugcuguguugucuagguuggacuccaacuccugggcucaagugauccuagcaccucagccuccugaguagcugggacuacagguaugccguaccauguagcuuacguaacauuucguauuucuguuagucuugggauuuuucuaaggcuuaagagugauuugauuuguauucaacugcauuaucgauucuugacauuuaaugauguaauucuaauauuuucaacuggcuagauuuucaaaauggcuuuaaucuucaaaguguacaauuuuuaacagguaaaauaugccaauauuuguauuuuauguacauuauuugaaacccaguaguuuuaauuuaccaaaauacacuuuucaauucuccuaauguaguuacuagugaauaagacauguuucagauagaauccuggcucuuugacuagcuuugugacugaacgaauuuuuaaccuuuaagccucaguuuuucucaucuggaaaauggagauguuaugaaaauugcauggcauugccugcacauauugagguuucagucuuaguuauugcuauuauuaaauauuaauaaucuauaguuaaccucuguauuuccuucuucaaauuuuugagggcauacauugaagacuaguaaaauagcuacagauuauugaauugugauuguccaaauggaggagagcagugccauggauaacuugaaguucaaauguuagcuuuggaauauguaauguguagcguguggcaaagcuguuuuuguuuaagccaagacuagccuuuucaucccacaaaccuauacuaagugacagagaagugaguacuggcgauuugcuguuaggauagcuggcauaaguuuaaacauuuuuauuggaauaauauacuuaguauaucaugaaggcuuuauaauacuguucauuucacucauuuaauauccugcuuccaaggugguaagcucugauuaaggugauaggaacaacaacagcaacaaaaaaacauaauucagcccuaauggaguuuacauucuaguggggcuauaaauaucuauaagguaauacuugguuucgauaaguuuuuuuguuuuuuuuuuuuuuuuuuuuuuugauauggagucucgcucugucucccaggcuggagugcaguggcgcagucucggcucacugcgagcuccgccuccuggguucacgccauuccugccucagccuccugaguagcugggacuacaggcgcccgccaccacgcccagauaauuuuuuuguauuuuuaguagagacgggguuucaccguguuagccaggauggucucaaucuccugaccucaugauccaccugccucggccucccaaagugcugggauuacaggcgugagccacugggcccggccgguuucgauaaguuuuaugaggaaaacucgagggauaacguaacuccaggugagauugaguuaacaaauaaagcacuuuuuccuguaaaagugcauuugaugagaucgggcguguucagagugguaugaucauagacugaaagugcauuugaaaugacccuuuaagaagauaaaugauuaucaaaagcaaaccaaaacaucaucuuuuuuuuuuuuuuuuuuuuuccucagagccucacucuguagcccaggauggagugcacuggcgccaucuuggcucacugcaaccucugcugcccagguucaagcgguucuccugccucagcucccaaguagcugggauuacaggagccugccaccgcgacuggcuaauucucguauuuuuaguagagaugggguuucaccaucuuggccaggcuggucuugaacuccugaccucgugauccaccugccucagccuccgaaagcgcugggacuacaggcgugagccaccgcgccuggcccaauaucauccuuuuauaugccauuuugaggaauuuuucccccaauuuuaaaugaacuuuuuauuuugagauaauuauagaaucacccgaaauuguaagauacaauacggauaucucauguacucuucuuuuauaaaggauaguaacaucuuuuguagcuguaguacaguaucauggccaguauugauugcuguagucuacuuguuuacauuuccacggucuuauuugcacuugcguguguguguguauguguguacauauuacagaucgugccuaacuuaaugguuuggcuuucaauuuuuugacuuuuuuuugacaauuuuuugagacagagucucacucuaucacccaugcuggagugcaguggugugaucucugcuaacugcaaccuccgccuccuggguucaagcaauucucaugccauagacucaugaguagcuggacuuacaggcacaugccaccgugccuggcuaauuucuuugccuuuuuaguagagacaggguuucaccauguuggccaggcgggucucaaacucuugaccucaagcaaucugcucaccuugaccucccaaagugcuaggauuauaggcgugacccacugugccuagccuaauuuguuuuuaacuuuuaauuuuuuuuuaaggagacgagcuggccuugaacuucuggccucaagcaauacuccugccuuggucucugaaguagcuggggugacagguggaagccaccgugccaagcuaauuuuuuuuuuuuuuuuuuuuuugagacaguuucccucugucacccaggcuggagugcaguggcgcaauuuuggcacacugcagccuccaccucccagguucaagugauucucaauucucaugucucggccuccugaguagcuaggauuacaggcuugcgccaccacgcccagcuaauuuuuauauuuuuaguagagaugaggguuucaccauguuggccaggcuggucucgaaccccuaacuucaaggcugccucagccucccaaagugcugggauugcaggugugagucaccaugcuuggcccucaguuuuuacaugaugaaagguacacuuuuuugguaaaaauuuacauuggaauagaaguguauaaagucaaaauaaaucagucuccucaucuuauuguccaggguuaaucauuauuaauagucuguguguuuagaucuuuucuacacauuguaugguauagacauauaucuaguauauauauuaaaauauauguauaccauauauaccuaaauauauauauuuuuuccucuuucucugucucucucucucucucucucucucucauauuagcuuggguugccaaaagaaaauauuauaggcuggguaguuaacuucccccugccccuccuccccccauagauccaggaacuugaguggcuaggugguuuaaauaacagaaaaguauuuucucagacuuucagagguuggaagucccagaugaggaguuggguuccuggugagggcucucuccuggcuauauuaucuagguaugugagcacccaaaccuagaugguauagccuacugcaugcuaggugauauggucuauaaccuguugcuucuaggccacaaauuuguacagccuguuacuguacugaauacuuuaggcagugguauacaaagguaaguauuuguguauuaaaacauuuaaacaggccaggcgcaguggcucacaccuguaauccugauacuuugggaggccaaggcaggcggaucaugaggucaagagauacagaccauccuggccaacauggagaaagccugucuccuaaaaauacaaaaacuuagcugggcgugguggagcacaccuguagucccaguuacuagggaggcugaggcaggagaauugcuugaacccgggaggcagagguugcaggguugcagcgaccugagaucgugccacugcauuccagccuggugacaaagcaagacuccgucucaaaaaaaaaaggaaaagaaaaaaauagaaaagguacaguaaaaauauaguguuacaguuuuaugugaucaccgucauacauuugguuuguuaucgaccaaaacauuguuaccaacaaaucaauauauguuugugucucauuucaguacuuaguaauuaguacuggaccgaaauuuuaauuuuauugcgguuucuuacaaaauaaaacuagccuuuggcuagucauucggucugugugaaaauacauuucuuugcagaugguccccacauuuugaauuuacaauucauuuaucagaauguagccccauccauaagucuaaggaauaucuagauuuacgaugauucgacuuccaguuuuugacuuuaggaugaguuuauucaggcauuaaacgcauuuuugacauaacaguacugacuuaaaauaguuacaucccaauaaaacccuuguuaaguagaaacuauuguuaaguugaaaaugcguuuaauucaccuaacccaucaaacaucauagcuuagccuagccuaccuuaaauaggcccagaaugcuuacauuagcuacaguugggcaaaauuaccugacagcacaguauacuguaucaguuguuuacccuccuaauugagugguucacugggagcuguagccugcugccauugugcaacuuugugacauaguaugauaccacgaaucacuaaccugggaaaagauuaaaccucaaaaucugaaauaugguuucuacugaacucauaucauuuuucacaucaucauaaagucaaaccaucauagucaguugggaauugucuaaguaaggguaugcagaucucacuaauccuggcugagucaguuggcauguagguaauagcccucuucccugaaaaaagcuuugucuuuucugauaccucuuuuggcauucucucucuugcuuuuucuguaaaaaauaaagauacuguuccuauuuuucuaaagcuaguuugauuuuuuuuucuuuucuuuuugagacaaagucuugcucuguuucccaugcuggagugcaguggugugaucacagcucuuugcagucucgacuugcugggcucaagcgauucuucugccucagccucccaaguagcugagacuacaggcauaagccaccauguccagcuccuuuuugaauuuuuuguggagauggggucucccuguguuucccaggcuguucucuaacuccugggcucaagugauccuccugucuuggccuccgagaauguuggaauuaaagaccaccacacccugccuaaagcuaguuuuaaauuauagcguguguguuuguauauauauauuuuuuagagauggggucuugcucauuugcccaggcuggaguacugugguacaaucauagcucgcugcagcguugaacuccugggcucuagcaaaucucucuccucaguccacugaguagcugggacuacaggcauguaccaccaugccugguuauauauuuuuaauauuuaaaaaaaugccagugucagaaaaauaagaacaauaucuuguuuuuggaauuagaaauguaauacaugcacagguuaaaaauuuaaauagugcaaaagaguacauagugaaaaauagccuccuucccucccuaguuaccugaucccugucucccagagacacucuuucuagcuuauuugggguagccacugacaaauauucuuugccuauacuauuauucauauguuuauauuucucuaugucuaacacauuaacacacauauauacacauaugcaugagugcacacauggaagccuaauguacucugaauuuucuuaccuaauggcuuaucuuguaguuuguuccacauucgcacauagaaaucuacuuuauucuuucucguggcuguguaaauauuccauuauauguuuauauuauuagauucuuuauaauggauauuuuagugguuuauagucuugcuauuacaaauguuggcacaaaguuauguuuuaauguacuauguauauuuauuuacauauauauuuacacaauuaugugauauauacuuaaggagcauauagagucuucaguaaucugguucacaguugauacauuaaaaaaaaacacugugugggguguggcgacucauaccuguaauccuaguacuuuggaaggccgagacaggaagauuacuugagcucagaaguuugaguccagccugggcaauguagugagacucuguuucuacuaaaaauaaaaaaaauuagcuaggcuugguggugcaccuguagucccagcuacucaggaggcugaugugagaggauugcuugaacccaggagaccuaggagguagaggaugcagugagccgugaucaugccacugcccuccagcaagacccugucuccacaaaaaagaaaaaagaaacucacuguauuuauauaccauugguugaaaauaagauacuugaaauauucauucauaucugccccgguaaaauuuuucuccccaauggcucacauaucuagaaauaguuacauaaaucgcgucuuugguaacuuaauaaguucauauuuguaaguagccuaguagucgcuagaaaguuucauuuggguauguaauaaaauuauauuguuauugauuauuuacuagucgaucuacauucauguuuuguuuguuuugcuuuguuuuuagaggucuugcucugucacccaggcuauagugcaguggcacacuuguagcucacugcaugcacccuugaacuccugggcucaaguuacccucuugccucagccuccuuaguaguuaggucuacagggacaggcaaccacaccugacuaauuuuuuaaauuuuuuguagagauagggucuugcuguguugcccaggauggucuugaacuccuggccucaagugaaccucucaccuuaguuggccaaaguguugugcugggauuacaggcauaagccaccaugccaagccuacauucuuuauauagauaucuuacgcugcuuuuagagauaucaaauacagcaguuauauaguuggaaaaagcuggaaaggacuuuauauaucuuuauuuuaacuuucuuauuuugcuccucuaaguuuacucugcuguaauacugauguuccugaauuugaugguauacuugauugagagaugagaucacggugaagaaggacaaaauggaaugagggcuuuuaaauuccauaagucaguuuuuaugguucauagaugcugugacaauaugucagcuaucucugaagccuccuugauacaugaugggacagggaaucuucugccuacucccaaaacuuuggaaaauuaguaaggcagcauuuaaagaaaauuuuuagcgagguccucagauaugauauauauuauaaaaagauuuaaugugggccaggcacuguggcucaugccuguaaucccagcacuuugggaggccgaggcgggcagaucaugaggucaggagaucgagaccauccuggcuaacauggugaaaccccgucucuacuaaaaauacaaaaaauuagccaggcgugguggcgggcgcggugacgggcaccuguaguaccagcuacucgggaggcugaggcaggagaauggcaugaacccgggaggcagaacuugcagugagccgagaucacgccacugcccuccagccuaggcgacagagcgagacucugucuccaaaaaaaaaaaaaaaaagauuuaauguauauauagguaauaucuuugaaaaacuuagauuaugacaagcauucagcuuaguguaauuugggcuaauaauaaauggagauuaauucauuuaauugguuaauaaacauuuauugaguguuuacucuguuagguacuguuuuagguucuuaggauaucuuagugaaccaaauagauuaaagaaaaaucccuucuuuuguggaccuuaccucuuaauggguaaagcagacaguauuuauaaauauaaccccaguaauuguauaguauguuaaaagauggcaaguccuacuaaaaacaaaaagguaauagaguaagaggcaaugggaguguaggaauaggguuguuauagaaugaaauagggauaucaagguaaaccucacugggguugaaauuugaguguagacuggagaaugauagccaagccagucaucaggagaaagaguaucucaggcagagggauagaaggcuaauagguugguguggagugaggaacagggaagaauuaggauuuuugcuuuuauuuugugucaaaaggagugauagaaucuaagguuuuaaaagaguucugugggccagguguuguggcucaugccuguaaucccagcacuuugggaggccgaggugggcagaucaccaggucaggagaucaagaccauccuggcuaacacggugaaaccccaucucuacuaaaaauacaaaaaauuagccgggcaugguggugggcaccuguagucccagcuacucggcaggcugaggcaggagaaucacaugaaccugggagucggagcuugcagugagccaggauugugccacugcacuccagccuaggugacagagccagacucugucucaaaaaaaaaaaaguucuguggcaagagggcaagagagaauuuaggagauuauuugcaguaauccagcaagagaugaugagaugauggugguuuaggcagguuacagcauugaaaauggcaagaacuagucagauuucagacauguuuuccagguagagccaauauaauuucacuuggaauguagggcauuggagagaggagucaaggguuuguuucaagaguguggaagguuauggauggacuugaugccagcugagaugaggaaggcugcagacagagcaaauaugggagagcagaucaggaguuugguuuugaacauguuacuuugagagauauauuagccauucaaguggagauuuugaggaguuagguagauacaagucuggaguucuugagagagauuaggacuggagaugauaaacuucaagucuucaguguauacuuggcauuuaaaaucauggaacuguaugaguucaccaaggaauauggcuucuauaagaacuugggaaacacaaaucuauugauaaaucaguaggcuauuuucuuuuucuuaggagaaagaaagaauagguaaguaacauuuggguucuacauaugugccagucaugccauauauauauuugcauacacuaucccaucacauuuaauaacuauuucaugagauagauacuguuuucauuugacagguuaaaacuagcccuuaaaaaaaaggcuaguuuuaauaagcaaacaauuacaaauccucucucuauccccugcuauaugaccuuaagaaauugaagucagaggcugggcccuguggcucaugccuguaaucccacuacuuugggaaggugagggggguggaucgccuuaggucaggaguuugagaccagccuggccaaccuggugaaaccgugucucuacuaaaaacacaaaaauuagcugggcgugauggugggcgccuguaaucccagcuacucaggaggcugaggcaagagaaucgcuugaacccaggaggcggagguuggagugagccgagauggcgcuauugcacuccagcuugggcaacaagagugaaacuccaugaaaaaaaaaccaaaaaacaaaaaaaaauguguaucuuauuacaguugaguccuuuugugagacgaacauucaguguuugcuagauuauucuaauuagcuaccuuuguaugguuagguuagcauggagcugaagauaaaugucccguuugaaaaaaugacagcccuucagaaaacucuggcaguuuacagaagaaauacaaauggccaauagguauauaaaaguuccuaacaagugaauaaaagcaaauuaaaacaggcauucacuuauuuauguuuuaccuuucaaguugauaagagcacaaagauuguugauaccuaguguuuguguggguaugggggggaaaagacacucugguaugacgcuuuucgaggucaguauucauuaaaauuuaagauguccacauccuuuggcacaauaguuuauuguuagacucauucuauggaaacacaggauauauguacagaguuauucaacgcagcugaucugacguagggaaaaguugaaaauagugaaauucccguuaguaaggguguuauccauauagcaggauaucauacagcaguaaaaacaagaguuuuauauacagacaagaugcuuaaaauauauuacuaaauaggaagaagaaguuacaaaacuauguauaauacgcuuuuuuuuuuuuuuuuuuuuuugagaccgagucucgcucuguugccagccuggagugcaauggcgcgaucucggcucacuguaaccucagcauccuggguucaagcgauucuccugccucagccucccgaguagcugggauuauaggcacccaccaccaugccuggcuaauuuuuguauuuuuuuuaguagagaugggauuucaccauguuggccaggauggucucaaucucuugaccuuguuguccuccugccuuggccuccagaagugcugaaauuacaggugugagccaccauccccagucguaauacacuuuuaaaagauauguaagaagaaaagaucuagagacagcacugaguuguuaauguuaguauuucugugguggcaugaugggaaacuucgauuucuguauuucugaauauuuuuuccucaagucucuuauaaucagaaaaagaaucaguaaagauaacuaacauacacacguacaaaagacgaacccaaacccaacccuccagaugcuagcuuacuacaagauuuagcaaaauaauuggaaaugcaugugguuugcuaguuucuccaaaauucagcauuagccuucugagcucauccauggguuuggaugaucuuaagcugauacuuuaugugacaaguaagcugguuuuagaaauaaaauuuucucucuguuauuaaauuucuagccgcauuacuagaaaacaauaauggaaaacuuuuuaggccauuuauugcuuuauuggcagcuuucgauuauguagaaaauaguaauuaucuuggcauagaucucaaacuaaaacugcuuuauuggaggauauuuuucggugaguauucagauugaugauacuaaauagcuucacccaagaacccaauuuauuuaguuguugauauucaaguuuguaguaaguucaucuuggaauguguaugguauugcagcacuccccagaaucagcuguuuuuaccagagucuuacugcacugcaguucuuuucugauugaagaggcuagguaauaaugcauaucauaaacauguucaggucaaaauaguguacuguauacacuccagugaaacagugggaucucagcuggguaccugucguuaagccacuugauucaucuaaaauuucuguuucgggauuuuuugguuuuuuuuuucuuacuauaggccuugcuguggcuaucuuggugcauagauaugacaacuuccuuaagagccaguuugccagauagaccuugcaguuuguauuuuuuauauauuuauuuauuuugagacagaguuucacucuugucgcccaggguggaguacaauggcacgauuuuggcucacugcaaccucugccucuaggguucaagugagucucccgccucagccucccaaguagcugggauuacaggugcccuccacuacgcccagcuaauuuuuuguauuuuuaguagagacaggguuucgucauguuagccaggcuggucucgaacuccugaccucaggcaauccacccacuuuagccucccaaagugcuaggauuacaggugugagccaccacacucggccugacuuugcagguuuuuuuuuuuuuuucuuuucuuuuuuuuuugagacggagucucgcucugucauccaggcuguagugcaguggcgcgaucucggcucacugcaagcuccaccucccggguucacgccauucuccugccucagccucccgaguagcugggaguacagucgcccaccaccaugcccggcuaauuuuuuguauuuuuuuuuuuuuaguagagacgggguuucaccguggucucgaucuccugaccucgugauccacccgccuuggccucccaaagugcugggacuacaggcgugagccaccgcgcacggcgacuuugcgguuuuuaaaacaauguuaacuuuccucccuggaggucugauaccucugcagguaacucacuguuuacuaaaugacguaguauauguguucucuaggcacugacuagagaauguaauuuaauuauuaaacauauauuuaacauuuuugugcuagguaucauauagauguuggggaauacaaagacauaucaggccggacacaguggccuguaaucccagcacuucgggaggccgaggcgggugaaucacuugaggucaggaguuugagaccagccuggccaacauggugaaacccgucucuaccaaaaauacaaaaauuuagccaggugugguugcaugugucuguauucucagccacugggaggcugaggaaggagauuugcaugaccccgggagguggaggcugcaaugagcugagauggcaccagugcgcuccagccugggcaacagagugagacuccaucucgaaaaaaaauaaaaauuaaaaaacaaagauguaucggacauggcccuggucauuugugagugcauagauuaauaaaggaguuugacauuauaaauuaugacauaguaugauauauauauauacacaucucauauauacacacacauauacauaaaauguauaacaaacucuauucagggauauuuugagaggugauauuugaaauauuuuucgaaagauguaugaggcauacauaccugguagaaaagggcauucuagguagaugagaaaagacacagauuuugagaggaagcucuauucauaguuuuguagucaucugaugugguuagagaauaggccaauuauggagagugguaccagauaauaagcuguggccacguugugaaggcccuucuaggauaugcuaguaagugauaugauaagaucuguguuuuaccacccccaaagcuggcagaagacaagaaauaaccaaaaucagagcugaacugaauaaaguugaggugcaagaaaccauacaaaagaucagugaaaagagaaguugguuauuuaauauaauaaauaagauugcuagacugcuaacuagacuaauacagaaaaaagaagauccaaauaaacacagucagaaaugacaaaggggacauuaccaccuaccccacagaaauacaaaaaacccucagagacuauuaugaacaccucuaugcauguaggguagaaaaccuacaauaaauggauauauuccuggaaauauaccuccuaagauugaacuagagaaaaauugaaacccugaacagagcaauaaugaauucugaaauugaaucaguaauaaaaaaccuaccaaccagaaaaagcccaggaccaaauggauucaaagcugaauucuaccagacauauuaauauaaagagcugguacaauugcuacugaaacuauucaaaaaaauggaagaggaggggauuccuccuuaucucauucaaugaccagcaucauccugauaccaaaaccuggcagagacucaacaaaaaacgaaaacuucaggccaauauccuugauaaacauagaugcaaaaaucuucaacaaaauacuagcaaacugaauccagcagcauaacaaaaagcuaguccaccaggccaggagcaguagcuuaggccuguagucucagcacuuugguagccaaggcagguagauggcuugaggccaggaguucaagaccagccuguguaacauggugaguaccuaugucuaccaaaaaauuuaaaaaauuagcugggugugguggcacacaccuguaguuccagcuacuugagaagcugagguggaaggauggcuugggccugggaggcagagguugcagugagcugagauugggccaugguacuccaaccugggcaacagagugagacccugucaaaaaaaaaaaaaaaaaaaaaaaaaaagcuaaaucaccaugaacaaguaggcuuuaccccugaguugcaagacuggucgggcauacacaaaucaauaaauguuacccgucacauaaacagagcuaaaaacaaccauauuaucaucucaauagauguagaaaagguuuucaguaaaauucaacaucccuucauguuaaaaacccucaauaaacuaggcauugaaggaacacacuucaaaauaaugagagccauguaugacaaacccacagcagcaucauaacugaaugggcaaaagcuugagaacuggaacaagacaaggaugccuacucucaacacugcuauucgacauaguacuagaaguccuagccagagcaaucaggcaagagaaagaaauaaaagguauccaaauaagaagagaggaagucaaacuaucucuguauaugauaugauuuuauaccuagaaaaccucgucgucucugcccagaagcuccuaaaucugacaaacaacuucagcaaaguuucaggauacaaaauugauguacaaaaauccguagcauaucuauacaccaacagcauccaagcugagugccaaaucaagaaugcaauccuauucacaauagccgugaaaaauaaaauaccuaggaauacagcuaaccagggaggugaaagagcucuacaaugauaauuaggaaacacugcuaaaauaaaucagagaugacacaaaugcaaaaacauucgaugcucauggauaggaagaaucaauauuguuaaaauggccauacugcccaaaacaaaauaaauauucaaugcuuuuccuaucaaccugccaaugacacucuucacagaauuagaaaagacuguucugaaauucauauggaaccaaaaaaacagccugaauagccaaagcaauccuacacaaaaagagcaaagcaucacauuaccugauuucaaacuauacuucaaggcuguaguaaucaaaacagcgugguacagguacaaaaacagugacauagaccaauagaacagaauagagagcccagaaauaaagccucacaccuacaaccaucugaucuuccacggaguugacaaaaacgagcaauggggaaaggaguuccuguucaguaaauggugcugagauaacuggcuagccauauucaaaagauugaaacuggacaccuuuguuacaccauauacaaaaaauuaacucaugguggauuaaagacuuaaauguaaaaccuaaaacuauaaaaacccuugaaaaccuaggaaauaccauucuggacauacgccccagcaaagauuucaugaggaagaugccaaaagcaauggcgacaacaacaaaaaauugacaaaugagaccuaauuaaagagcuucugcacagcaaaagaaacuaucaauagaguaagcagacaacccacagaguaggacaaaauauuuguaaauggugcaucugacaaaggucugauacccagaaucuauaaggaacuuaaauuaacaagcaaaaaacaacuccauuaaaaacugggcagaggacaugaacagacgcuuuucagaagaagacauauacucagccaaugagcauaugaaaaaaugcucaacauuggcugggcgugguggcucacgccuguaaucccagcacuuugggaggcuggaggcagguggaucacgaggucaggagaucaagaccauccuggcuaacacagugaaaccccgucucuacuaaauauacaaaaaauuaguugggugugguggugggcgccuguagucccagcuacucaggaggcugaggcaggagaauggcgugaacccgggaggcggagcucacagugaguggauaucgcgccacugcacuccagccugggugacagagcaagacuccaucucagaaaaaaaaaaaaaagcucaacgucacuaaucauuagagaaaugcaaaucaaaaccacauugagauaccaucucauaccagucagaaugauuauuauuaaaaaauaacagaugcaggugagguugcagagaaaagggaacacuucuacacugcuaguggggaaagcaguuucaugauuucucaaagaacuuagaauuaccauuugacccagcaauuucauuuuuagguguauacccaaaggcauauacguuguucugucauaaagacgcaugaauauguucauugcagcacucuucacaauagcaaagacauggaagugaccuagaugcccaucaaugguagaccagauaaagaaaauuuggggcauguacaccauggacuacuacacagccaugaaaaagaacaggauaauguccuuugcagcaacaugguuggagcuggaggucauuauccuagaugaacuaacgcaguagcagaaaaccaaauaccacauguucucacuuauaagugggaacuaaauauugaguauacauagacauaaagaagggaacaauagacaccggagccuucuguuuuuauuuuuuuugagauggaguuucgcucuuguuucccaggcuggagugcaauggcacaaaucuuggcucacugcaaccuccgccucccugguucaaacgauucuccugccucaguccucuuaguagcugggauuacaggcaugcaccaccaugcccggcuaauuuuguauuuuuaguagagaugggguuucaccauguuggucaggcuggucuugaacucccgaccucaggugauccucccaccuuggccucccaaggugcugggauuauaggugugagucaccacaccuggccaauacuggagacuuauugagcagggagaguaggaggagggugaggaagggaaaaguacccauuggguaccgugcauauuaucugggugacaaaauaaucuguacaccaaaccccugccauauguaauuuacccauguagcaaaccugcauguauaccccugaaacugaaauaaaagguuuuuuuuuuuuaauauuuauuuuuuauuuuugagacagagucucgcucuaucacccagcuagagugcaguagugugaucuuggcucacugcaaccucugccuccuggguucacgugauucuccugccucacucagccucccaaguagcugggguuacagguguacgccaccacgccuggccaauuuuuguauuuuugguagagaugggauuucacuauguuggccaggcuggucucaaacuccugaccuuggguguuccaccugcgucccccucccaaaguguugggauuacaggcaugagccacugugcccggcuuuacucuuuauuuugaaaagauaacuauaguaggcuuuuuugacuucuaaggauggaaauggggaaaucauuuggaacagucuuuaugauaguuaaagggaguaacgcuaaggacaugguuuagggcaguggaaaugaauuagagggggcacauuuuagagagauuuggugaagcagcuacuugggaugcauaagggagagaagggaggcaaggauaacuaaguuuuuaguuuuaaaguacuugucacaugucuuagagacuuuuaguaauaggcaguuggaaaugugaguuaggagauuaggauugagugagaugaauauagugauuuuugaaauguuugaaauaaggcuuuaaaucucaacucugacacucacuaaaaugagaaauaaccauauauaucuuaaagaacuguugggauugugcauauaaaccugucaauaaguaacacuugguauuauuuuaucuaauuuaucagaacuaggguugaauguuucacaguaaauggaugagaguuuaagagggagagauugaucuauuuagauugcuggaaaguuaaguacuugaacuauaucguuaguucuuuauggaauuaccucacuuuaguuguggcauaauauucuuuucuguacuucuauugagaauaaauauaaaaaguguuucaagaaaucuuucaguugucuugaagaugucaugguguucaauguucuuuauggaaaaauccuuguaauaauuucuucgaauaguuuaguacuaggaaaaaugguuuuugcucaaacaaauugguauuuguuauuuuacuaagcaagcaauuuuuaaacuuccauuuucccuuuuuuuaucuugucuguuucaaaaugucugagcuuaauguuugacugaaauauuuuuauuaaccuguauuuuuaguuuaaucuauauuuaaucuuuuauuauguggcucuauuguauguuuucgggggcggggagcuuacacaacagaaauuuauugucucagguuuggaggcugaaagucuaagaucaagguguuggcuggauugccuucuucugagggcuguggaggauaaucuguuccaugucuuuccccuuagcuuuugguuugcugacaaucuuggacauuucuuggcuuguagaaacaucuucccaaucacuccugucaucuuuacuugauguuuucccuuugugugcaucuguguucaaauuucccuuuuuuauaaugucaccagucauacuggauuaggacugcccuaaugaccucaucuuuaauuauaucugcagugacucuauauucaaaugaggucacauuccaagguacaggggauuaagacuucagcauaggaaugugguggggguugggagggacaguugaacuucuaacaguugugugguuaaacaaaugagauaauaaccugaaaugccuuauggagcuucggaguuagguagagaauugagaauuugaacuuguucucuucaugacugucuccacagaagcuuuaucauaagggcaggaagcacaguguuuauagucauuaauugcuguuuucugacaguuugacuuuuuccuugguuugugaacuuucgagggaguuccagcucuucaaacagacaguaugucuuguccaccugcuuuggauuugagucuuguuuuacagacagcuucuguggguuuuauaacagauguguaaaauauuccagccuaccuuuuuaucauuuauuuuaaaauuaaaaagagaaaaaccuacauggaaaguuuuuccuaacacacucuauuacaaagagcauauuaguguuucaucagaaaaagcaggcuacuuuuugcaaauaaauaaguagauuuggcaccuaauaucaacugggcaugccaguauacugaauuaacacaacaaccuuggaaaguagaugcuacuguuuuaguguuacagaggaagaaacugagacuuaaguauacuguugaagguuaguaguuggcaacuggcugaaacagaccucauggucaguauuuguuaaaagucuaugcucauuccacaauccgauaaagaaaaggauggugugaguaucugcugaggggguagaggagccccuguuucuugggccugcacucacuguacugucaucuggcaucucugaggucucaguuuccucauuggaaaaguggaggcaaucagccgggugccguggcucaugccuguaaucccagcacuuugggaggccgaggcggguggauugcaugagcucacgaguuugagaccagccugggcaacauggcgaaaccccaccucuacuaaaaauacaaaaaauuauaugggcgugguggcgcacaccuguagaacccaggagguggagguugcagugagcugagaucacgccacugcacuccaaccugggcaacagagugagacucugccuuaaaaaaaaaaaagcauuuaauugaaaauaaaaguuuguacaaaugugcuaggcugggcucaguaacucaugccuguagucccaguacuuugaggggccaaggagggaggauugcuugaauucaggaguuugaggcugcagugagcugauuaugccacugcacuccagccugggugacagagggagacuuuuucucaaaaauaacaacuugccaccaagcuuaaaaaaaaaaaaaccuaacaaaaaugugcuauuagauuaaggaguaccaaaaagugaaaggugugcauaauuacagauacauacaguguaguuacagauaauuuaaggccgaaugcaguggcuuacaccuguaaacucagcacugugggaggccaaugcaggaggaucacuugagcccaggaaguuuuuuuuuugagacagcaucuugcucugucacccaggcuguagugcagugguaugaugacagcucacugcagccucaauuuccuaagcccaggaguucgagaccagcaacauaaugagacccugucucuacaaaaaauaauaaaaaauaaauucaaaacaaaacaaagauaagauaauuuacauuaguagauaguacagaaauaccugaaaauguaaaggcuuaaauacuguaguugaagacagcaauaaaaagucaaaaggaaguuuuuuuuucucaaaugagugauauaaauaguaucuuaagagguaaagguuuuaacagcuuggaauaauuggggaauacuuucuagagaagggcaaauuaaaaaauaauguuuaugaugaccuguuagaaaacauacuaggcacuuuacauagauuauuucauuugauuccacaccacaacccuaugagugagaugguauuuaaccucuuuuuucagaugaagaaaugaaauuuacaguuacuugcucaugcucauauaguauguaaauggcacaaguaggacccaaacucaauguguaacuccaaguauuuuuucuuucucaucauaccugagucuugaguauguauauuagaaauugauuauacuccagaugguaaagugugggagauuuuaagcauauaaugaguauaucauuguaacuggaggagaaaguucaaucguuauaugauucuuguaaagaucuuacaguagauguauacuuuuauuacuuuacgccaugaucuuuaaucuuuuguaaauauugguguaagguauucaguuuuuucccuagauggauacucaguugucuuaaguccauuuacugaauaaucccccuuuuccucuacuaauuaaacgaaaaguuuuauuggccaggcauaguggugugcgccuguagucccagcuacuugggaggcugaggugggaggauuuccucagccugggaggcagagauugcagugaguugagauuguggcacugcacuccagccugggcaacagagcugucucaaaaacaaaaccaaaccaaaaccuuuauugaaauguaauuuacaugcuauuaaauucaccuauuauaaguacaauucaguuauuuuuaauaacuguauagaguuauacaguuuuuuaaaauaacuuuaagauauuguuuuucauaacucuuaauugaaguuuucuugguagaugguaugauuuucauuuuauaauucauggcauaaucugcaucuuauaagcauuuugcccaagacuuuguggccaguaaauggcagaaccaagacucaaacucagcaccuuuuagaaguauuagcaugauaguugagaacaaauuguugaggauaugcuaaugucaaacuaagaaguuuggauuucauccuuuagcgugagcaucgccagcaucuucucuguaaugcccuacuuggcacuuguagcuggguacuuuuuggaaaaugucuucuaugauggaacucuagucucugaagauguuccauguagaaaggguucccuacucaaguaaauuugggaaguacucugacuucuuuuuggaugaucacaguucacauuguauacacacauccugggaaguuguacaguaaagaaauggguuuacuuguuuuuacucauuuucccccagaauuuuccaaguuucuugaccauagaugaccuuuugaguaacacugcucuaguaugauguuuuuggagaauuagacucaauucauuaagagggguuaagucugaagaagaaaauuaagcugcaggauuggauuuuuuuaaaaaguagguuauaauuguguacauuuaucuguuaauagucaugggguaacugcugacagauggagaaguucuuauuuuuuuuuagaccgaaucucacucuguugccaggcuggagcgcaguggcgcgaucucagcucacugcaaccucugccucucagguucaagugauucuccugccucagccucccgaguagcugggacuacaggcauguaucaccacgucuggcuaauuuuuguauuuuuaguagagacgggguuucaccauguuggucaggcuggucucgaacuccugaccuugugauccuccugccuuggccucccaaagugcugggauuacaggcgugagcuaaugugcccagccgaaguucugauucauuagguauaggauccuuugguccaaaguuugaaauuuugucucuugauuuauacuuauauauccuuuuuuuuuuuuuuuuuguagagaugggggucuugcuauguugcucagggugguccuggauuccugggcucaagugauaauaccaccuuagccucccccaaagugcugggauuacagacaugagccaccaugccuggccccauuucuuuuaaaaauuugaaagacuguuuaguauaguagcaagaucacuuuuaugucccacguguaccauuuacuaguguugugacuuugggcaagcuauaaucucugaaucaguuugcuuaaccauaaaauaaaaagaauaucaaccuugccacaguuguuauucagauguagauucauaucuauaaugauuguucaauuucuuauuauucuauagugucuuaguucauuucugcagcucuuaacaaaauauuggagacuggguaauuuuuauagaacagaaauuuauuucucagaguucuggaggcugggaaguccaagaucaaguccaaccaagguggguugguuuggugucugaugagggcugcugucuaugcuucaagauggugccuuguugccaccugcucacaugguggaagggucuaacaguuuccuugugcuucauaagggugcuaauuccauuagcaucauggcaugguccacccucaugacuuaaucaccaucuaaaggccccaauucucaauacuaucacauugauaaguuucaacacaugaauuuugcagggggucggggggacauucagaccauugcauucugccccgaucccuuaaauccuugucuuugucacaugcaaaaaacauuaauucuaucccaguagucucaaaagucuuccagcaccaauucaaaaguccaaaguccagagucucaucuaaauuagguauggaugagacucaagguauucauccuaaggcaaauugcucuccagcuaugagccugugaaaucagacaaguuacgcuuuucuaaaauacgaugguaggacagacacaggauagauacuuccauucagaaagggagaaauuggaaagaagaaagggauagcagaucccaagaaagcccaaaacccagcaaggcaaacaacauuaaaucuggaugccugagaauaaucuuguuuaacuccuuuucuugccuucuggacacacugggacuggggguggguccugaaggcuucagggaaccacgcccuuauggcuuuaucuggggcaacccuuaaugcaacucucacagguuggagucuggugccucuggcucuccuaggcugguguuggaugcugguggcugcacaguucugaggucucugggggcagucuugccuucacaacuucacuagacauaacccugguaaaagcucucugcugcagccugccccuuuggcaguucucugucuagccccugaggcuuucugaggaauccuuugaaaucuagguggggauagccaugccucugaguguacugcacuccugaagaguuagcaccauguaggcaucaccaagguuuaccccuugugcccacuuuugcccuccagaguggaggccugagcugcaccuggcugcacuugagccacaguggggguagucagggagucuugcuugggaauaaagggagcagagaugugaggcaacccugggcaacugggccucucccuagaaaacaguuuugugcucaaggcucugccauugugggccugugguagggaguagcagccuugaagcaaucugaaaugucuuuggguucauucuuccauugucuugaugaauaucaguugcuuccuuuuaucuauaugaaucucuuuaccuuuuuauuuuauuuuuuaucuuaauuuuuuuuuuuuuuuuuuuuuuagagaugaggccucgcuauguugcccaggcuggucaaucuccuuaucaaaaggucgcuugaucaugcuugugguacucucuuccaauaccacacccccguuuuuuauuuugagacagagucucuguugcccaggcuagagugcaguggcacaaucucagcuagcugcaaccuccaccuccuggguucaagugauucuccugccucagccucugccuggcugauguuuguauuuuuaguagagaugggguuucaaccauguuggccggguuggucucaaacuccugaccucaggugaucugcccacgucggccuccuaaaguguugggauuauaggugugagccauugcgcccggcccaauacccauuuuuaaucuuuacaaccuagccaggcugagaauuucccaaauuuuuaaguccugcuucccuuuugauuguaaauuugaucuuuaggccaggugagguggcucaugccuguaauccuagcacuuugggaggcugaagcagguggaucacucgggcuccagaguucaagaccaggcugggcaauauggugaaacccugucucuacaaaaaaaaaaaaaaaaaaaaauuagcugggugugguggcucauuccuguagucccaccuauuugggggccugaggugagaggauuccuugaacccgggaguccgagguugcagugagcuuagauugcgccaccgcacuccagccugggugacugagacccugcuucaaaaaacaaaacaaacaaacaaaucuuuaauucauuucucacauauuacuauaagcaauuaagagaagcaauauagcauccucaacacuuugcuuagugauuuauccugucaaauauccuaguuuaucccuugaaaguuugccucaccuuacaccucuuuucuacauacaggcacuaaugccauucaugaggacucuguccuugugacuuaaucaccuucuaaaggucccacuucaguaauaucacauuguggauuaaguuucaauauaucaauuuugggagacacauugagaccauagcacacagagauguaauaguucuacagguugaguauaccuuauuugaaauaccuggggcaagaaguguuuuggauuucaaauauuuuuggauuugggaauuauuugcauuauaccuacucgcugagcaucccuaaccugaaaaucaaaaauugaaaaucuuccagugagcauuuccuuugagcaucauuggcacucaaaaaguuucagauucuggagcguuuuugguuccagauuagggaaguaauaauaaaccuuuaauacagauggcaauagagcuuuuauggaaaagggaauugcagccugggcacaguggcucaugccuauaaucccagcaguuuggaaggcugaggcgaguggaucacuugaggccaggaguuugagaccagccuggccaacauggugaaacuuugucuauacuaaaaauacaaaaauuagccaggcaugguggcacaugccuguaaucccaguuacuugggaggcugaggcaggagaauugcuugaacccgggaggcggagguugcagugagcugagaucgugccacugcauuccagccugggcaacagagcgagacucucuuaaaaaaaagaaguguauuguggcuggaugugguggcucacgccuguaaucccaccacuuugggaggcugaggcgggcagaucaugaggucaggagauggagaccauccuggcuaacauggugaaaccccgucucuauuaaaaauacaaaaaauuacuugggugugguggcaggcaccuguagucucagcuacucuggaggcugaggcaggagaauggcaugaacccgggagguugaacuugcagugagccgagaucacgccacuacuccagccugggcgacagagcgagacuccgucucaaaaaaaaaaaaagugaauugcaaacuauuaguccauggaaacaguguaggauuuacuuaaaguagcuugcaaaaauaaaggauugaaggacugaaaaauucuugaugauauauucuugguaauuaaggucacucacauaucuuacacuuaaguaauuuaaauuuaaaaguauucuacaugcauuuucucauuuuuuuuuuguuugcuuuuuuuuuuuuuuuuuuuuuuuugagauggagucucgcucuuguugcccaggcugaagugcaguggcgcaaucuuggcucacugcaaccucugccucccggguucaagugauucucuugccucagccucccaaguagcuggucuuacaggugcccaccaccacgccuggcuaaugcuuguauuuuuaguagagacaggguuucaccauguuggccaggcuggucucagaugaacugagcucagguaaucugcccaccucggccucccaaaguguugggauuacaggcaugagccaccgcgcccggcuguauuuuucucuuugaacaccuggugaaguagguuggauaugugccuguucuugguaauuaaaaaaaauuaauauauuuaugaucuguauaggauggaauaacguaucauugguuagugauuuuuuccuaacugcacuccaaguaucuauuccucuuuucucccuuccaaaacaagaaaagucaaacguaaguauaugcguguguggaauguuuacuuuaaaaaauaauaauuuuaggccgggcacaguggcucacgccuguaaucccagcacuuugggaggcugaggcggguggaucaugaggucaggaguuugagaccagccuggccaagauggugaaaccccaucuuuacuaaaaauacaaaaauuagcugggcguggugacgggcagcuguaaucccagcuacuugggaggcugaggcuggagagucacaugaaccugggaggcagaguuugcagugagcugagaucacaccacugcacucuagccugggcgacagagcaaaacuccaucucaaaauaauaauaauacaauaauaauaauaauaauuuuaaccauugauuacuggcuauaucagcacucccuugccaccuacccuuguuuugguuaaguccagucagguguuuccucugcuagggagcauaagucgucuucuaucaaaguuguguaucugaaaggaauauauauaccaguguuaauauagugaaaauaacuaccagaaauuuguguguuuauugggacaaauucuauuucuuaaugauaagguguuauuaaaaggugggaacuuuauaagaugguuuuauuguccucugacaauaguuuaauauucauuaauuuuaccaguauuucauuuugcuuaugugcaguggaccuugcuuucgaggaacuuaaaaauucuauuaagacaagacauugaccauagauauuugaauucuuggcauguucaauaauuguucuauuggcuuguacaaaaugugaaaagagaaaauuggauuugaaauuaauaaacauaauaaaagccuuugaagugaaaagcauuuaaaaucaaaaugcuauauuagaaaacaauuuuacucuagaauuguacucuauuuuggaguaaccauucuauuuuauuaggaaaaugugaagaguagaugccuuaaggaauggaggaaccucuccccuuauggauugcucugucaucaucaucaucaucaucauuacugugaaaauaacuacauuguaaagaaagucauaagauaaaugacgaaugucuuuauuuauuuuuucauuuuuuuuugaaauggaguuuugcucuuguugcccaggcuggaguguaauggugcgaucuuggcucaccacaaccucugccucccagguucaagugauucuccugccucagccucccgaguagcugggacuacaggcaugcgccaccaugccuggcuaauuuuguauuuuuagcagagaugagguuuuuccauguuggucaggcuggucucaaacucccuaccucaggcgauccgcccgccuuggccucccaaagugcugggauuacaggugugagccaccaugccuggccaaacaucuuccuuuuaaccaaccacaugacccaaaauuguuaacauuuugacauauuuagucauuuuuuucuguguauguguaagcacacaucauuacccucaaauaaaaauguguuccccuuucacuucacauuguaaaugguuauuacacuagaaaggaacaaaacuugcuccuguuuucuacuacacucucacacaacacuuuugacaccagaaguguggaguuuuuuucccacaccagccaauucuccaauucucugguuaccacauggguguccuacaauucaauuaugacacuacuuggaguuagugcggacuccagagguuaagagcucagucacgcaagacugcucuccacuucagauaccagugacauguagcggguccucagauuauccacacuucuauccgacuuggcuacaaauugggaguucccacgaccccuccucagguuugauaauuugccaugauggcucauggaacucagggaaacacuugcuugacugguuuauuacaaaggauacagaugaacagucagaugaaaagguagaacaaggaucuuuuuucucuguggaguuggggugugccacccuccuggcucauaaauguguucaccggcccacaaacuccuugaaccccacaguuaagggauuuuuauggacgcuucaucucgcaggcaagggaaauuauuaacucagccuguagccccucucuccucacuggaagaugguuggguagggcugaaaguuccaaacugguaaucagggcuuggucuuucuggugaacggcucccaucuagguaccuaacaaaagucaccucauuagaacaaacgcuacuccuaucacccuggaaauuccgagggauuuaggaggucuguguuaggaaccgaggucagagaccaaauauuugaaccaaagaugcucccagcaccaaauauuugaacaaaagaugcuccuagugccuaucacuuaggaaacaaguuuuuuuaggagcucugugccaggaacuauagaugaagacaaaagaaauauguauuucuuucgcagugucacagacacauacaauuauuuagucuuggcugggcacgguggcucacgccuguaaucccaacacuuugggaggccgaggcggguggaucacgaggucaggagauugagaccauccuggcuaacaauggugaaacccugacucuacuaaauauacaaaaaauuagccgggcguaguggugggcgccuguauuccaagcuauucgggaggcugaggcaagagaauggugugaacccagggggcgaagcuugcagugagccgagaucacgccacugcauuccagccugggugacagagcgagacucugucucaaaaaaaaaauuauuuagucuuuauuaucauuuucuauaacaguuuauuauggaaaauuuuaaacuuugauaaaaguagagaggauagugucaucccugucacccagcuucaacaaugauugauuuuucccagucuuauuuugucuguccuccaauuuuaguucuguuuugcugaaauauuuuaaacauauccuggacauuaguuaccaugacuuugaauuauuucauaguaguuuuucuauggauuuacuuaaucauucuucugucguuagacacguuaaccuacaaggaagaagcugaggcaaaauuaauauaaacagagucagccaggcauaguggcccuguaaucccaacacuuauagaggcugagaugagaggaucacuugagggcaggaguucgagaccagccugaggaucauaacaaaaucgucucuacaaaaacaaaagaagagaguuuauuugggccagacuugaggguugcaacccaggagcauagauucaaguugcccucaauauauccucugauuagcaguaguggauuuuuaaagguaaaauggggggacagggagugaaagugugucaggaauucucauuggcuuacagaaauaacauugauucagcuauacauuguuaagcuguagggugaugguuacaguguccaauguggcauuauuagguuaauuuauagcuacuuacggcaauagcaggcaguuucaagagaugagcacauagcucaaaguggggaguaggcugugacugcugucucauuuuaauaccucucugggccugauauuaaaaggguuugcauucuucggauaauaaauaguucuuuuuuuucccauuucacauuguuucaaauuucuuguuaaagaugaacuuuuuauauguaaauauuuagguguuucugaugauacuauucagccauauccugaaguuguaaucaccaaaagauaugaaccauuaaaauaaacuuuuuguaauuauaaaugcaguacauuuucguuauggauguuuugggaaauaaauuuuaaaaacuaagaagaaaauaaaaauuaccucagauuguuuuccaaagagacccaacaucccuucuauccacauuuuuguaguuugcuucuuacugggguugaaggggguuucucaaugacugccuggagaagagcaagccuacuugcggcccaucuuauuguuaaacuagcagauuagaaaauagcuguaugcuaagcacuuacuaggaaguagcaucuaagacacagugucccguugauugcccuaauaguucuacaguccuucaguaucauccuacccuaaacucuaaagagaacuaucaguauuccugaaugccauccuauugcuaccucugcagauuuuuuucccccugaauuuugaguuagugugagucugcugguuuguuucaaaagauguguuuugagaaacagucuugagaaaauugcuucuguuuaccauccagugauucacaggagaaauuguuguccuuuuacugaguugaagaaagaaaacuugaugaagaaacuggaaaugcaagugguagaaacuuaaucauauugugccugggggcuauuuggugacucagaaaauaaauuauuucugugggaaauaauuagucagcuugagcacuguuuaacauauuucuggagccaacccaauuuuauuugaucuuaccuguuaugaacugguaaauaaaaauaagugugacagauuugagacuuuacaacuuauuuaggaacacagaagugaaaucaauguuucauccucugaaauaauuuuaaauacuugaauuuuccuucucuuucaguuccaggaauggauggaggugcuuuaacugauacaagucucacagauuccuauuuuagcaccagcuuuauuggagucaauggauuuggaagcccuguagaaacaaaauauccccugaugcagguauccuuaguauaaauucauauugcacuaugaaguuuauucuagggccagaggacauauagagucuucauuuauuccuacauuuguugagugggaggugagauuuuaggaggcagugagaugggugagauguagguaaacuaucucccaugggguuggaguuaaugagagcuuuuguaaguggggguuugguaggguuaggggcaagagugacgggaguauguagaggguaguuagagacuaauuucacuuguguauuuuguauguauguuaguuaaacuugguagugauugcaauuuuaaaauuauguuuuaagcagguuauacauguauuauaaaaguuaaguuacaaaagggccucccucucgucacuacucaucacuuuuccaguuaaccuuccuagaguuagcuaucauuacugguuacaaguuuccuguguauccucucaggaauauucuuugcauauagaagcauagugcuaguuuuauuuuguuuaaugcuuaaaauguugaauuuaaagucauaguacuuggagcauuuuacauuaaaaaugucuuugaauuuuuuuuaaccccacuuuguucuuuuuggcucuuuuuuuccccuuuaucauaugacugcaugcaaugcuuaggagauuuguguuuagaugaguuuuuguugauuuguauugcacaauuuuguagaauuggaauaaaauuggaaaguauucuaguguuuuuaauuggaaaacugccauaauaguaaaggcaauguauuguccuuucuaguuucugugauguacuacuggaugguuuucuccauuauuacaauaggauauuuaaacacaagagaaauucaucuuuacguuucucucccucucucucucuggagacagggucuugcugugucacccaggcugaaguacaguggcgcaaucauggcccacugcagcuucaaccuucuaggcacaagcaauacuccucucuugccucagccuccugaguagguaggacuacaggugugugccaccaugccuggcuaauaaaaauaauuuuagcagagaugaggucuguguugcccaggcuagucucaaacuccuggucucaagugauccuccugccguggccucccaaaggagguauuacacguugggauuacaggcaugagccaccacuccuggccuaguguuuauacuucaaguuggacugauuuuaaggguuuguaugaaaccaaugcuuuuuugaauuauuuuaacuuauuucguguagauaugcacucuaaggguuguuuauaaagaaacaugcacagccauauauagaaaugguuauguuuuaugaacaauauaacuaguuuaaugcauaguuauaccuuauuuuaacugccugugagccacaauuucagguacuuuuuaauauauauuuuuguauuaaaauuaccucaggagcuuagcuuuuuucuucucuuuuaaaauuaugcagacauuaaauaagaaguugaguaaacagauucaggacucuagaauuaaagccagagcuagaaauucuuaacuuauaauuuuuaaggcauugaguuagaaguuacauaugagacaaggauuugugggcaugggaugaagggccuuacaggauggagagaccauacaggcuauggagugagucuagaaagcauagaacguguuuagagaacagaaaauaccuaauuuuauaagcucuauaagguguaugaaugguaguacaaauggagaaaggguauuagagcauuuacucauuuuauucauagucaacggguacccucuucaguggauauuggaauuuauguuuuacagacaaggaaacuuaguuauguguuuugcccaggcuaauaaguuauggaagcacaauucaaaauaggucuguagcuuuggcuuugaauaccuggguagugaguaaaauuuucauuucauguggugguuuuuacauaguuguaauccaagcaguaacacuuacaggaagauuagauugucaguaaugugaacaguagauuggaggggaagaagcaaagagagccagucuuaauugguuggauacuuuuauuucuguauuccucagugauguuauaaauaaauauuuuguuuuucagagaaugacuaauaguagcagcuccccaagccuucuaaaugacagugccaagccauauucagcccaugguaagaccugaucccuuuugcuuaugugugucuguguauauauuucuuacucuaaaaguaauauacaaccauuguagaaauuuugaaaauuguaaacgggcauaaagaagaaaauaaaaauuauuaucuucccacucagaucuaacuauugagauuuagauuccaggccaggugugguggcucaugccuguaaucccagcacuuugggaggcucaggugggaggaaugauugagcccaggaguuugaaaccaacuugggcaauauaacaagaccaugucucuauuauuaaaaaaaaaaagaaaaguguauaaguuauauacaaaaauuucaacaugcuauuuuauuaacaucuugcucuuugcacuauuaguuauuuaauauuaaauucauguuaauuuuaaugaagguaagucugaaaaaccaggaagaagaaggcagagaaaugaagcagcagucuauauguacuacauugugaagagauuuaagguuccuuuacguaagggcauuuaauauauuuuuuaggauuuagcagaacauguaaugagauuaauaaauaaaaaauuaaagcucagaaaugaagauaaauauuuaaguauaucucacacaugccuuuucagagacucuucucauuuguaaagugagaaauaauuaagauauauaauuuuauuuguaacuucuuucuacagaguaguggaauuuugaaccuacaaaaucuuuggauuucauguuugaaauaaauuuugaaaaacuuuauuauuucugucuuaacuuaauauuuuacuuuaucuuuuuaguaauaauaucaaacaucuggugauagacuuuaaaauauggaauaguuugcagaguaaaugguuuuaaagccuugcugauguguugaaauccaagacaggaucucucagagucuaugguugacacugcccccaccccucacccuccuuuuuauccuucccaagauauggucucaagauuauaaaccuuuauuuacuuuaggucaacuuacugccuucauaaacacacucacaauaguaugguuaagagguuuuuuucucuuauuugauuuuucuuuugguucuagucaaauagaucuauccugauccauauagcuuuugaauauuugagcaaauugguucaccaguuuguguuuuauuugcucagaaaauauuugaacauaacuguguguuagguacuaaguuuaauuauugugucauuugauuuuuauaggcauugucaaauuaaacaguuauuagauuugcggguuacccaaguuuuauguguggaaacuuacguaacuuaccuuucagauccucuaacaucaccugcuucauccuuguuuaaugacuuuggugcccucaacaucucucagagacgaaagguaggugaaauugaaacuugaauuaaacuaaauggaauuuagaagugauguuggcauuguuaccuauguagugucaauguuuuuguaaguggagggagagcuuuuuaugggcuuuaguguuuuuccugccuuuuguuuauccuuuuucuuuaucuuuuuauauguggaaauuuauuugaucucugcauggaauagagauuuugugugaagggaugaaauccugcuuauuuuuguucaguuuauuuaucucaauguauucuguucuuaagauaacaucuaauuuaauguuaaguugcuguuaaugugacccauuguaagcauguuaaucauguuuaaacuuuauuuuuugauggcuuuaucuaaauuucaaaaauucuucccuaauuuacuccugauuacaaggcaaacuuaaaauuuucaacauuucauaaugggcccaacaauuuaaaaaguugaaaaucucuucacauuagaaauuuaauuuuauuuggaauuuagauugauagaccauguauggauuuuugaaguauuuuauaaggacugauguugugacaaguugaauaauuugaugccuuugagucuuaaugagaaucuuguuaauacuaauaaucaucuagagaagauagucuuuuuugguuaggaucagcaacagcuaaagauguuaaagagguucuaaaucuugguggaaguuauuauaaaguuauaacauuguuuccuaaguaauggaagaaagacccaaaauuuaaugagaguaauaaauguaaaauuaacuaaagcucagaaaugaagauaaaauauuucaacauaucucauuaauauuaauuuuagaauaacugauaugaacuuaagauacuuuuaagaaggaucugaucagcagauaguauaaaaugaaauucaagaagacuguggugguguuggcuucacgguguauaguuauccccaaacucguugaguuguauacauuaaauauguauagcguuuuacaugucaaucagaccucaauaaagugguuuaaaaaauucagaaagacuagauuuucuuaagagaaaaaaaaguuaugaagacugauauaaauuauguuaaaaccucauguaccuaauguuauuuccauuuugagacauggaugagaauaagaagguaauuacaaaaugcuuuuuagcaacuagaauugauagacuaaaaucuguggguuuaauggauuuccuuauaggcucuuaucauggauaaauuuacccugcuuuacauacuucucuuauaaacuggaauacuugguuucuaaauccguauguuagcaguguaauaauagaguuggacagaaacagacccaggacaauagacaaagccuaacaauguggaagcaagcaguaaaaugcugaaaagcgaauacaaccuggaaaucaaguuaucuggagcuuuuuaugggaaaacagaaagucuuuaaauuuucuuagguauucccuaaucacuuuuucucauuuauaaaauaaucaguuaacuuggcugggcaaggggcucaggccuauaaugccaacacuuugggaggccaaggcgggagaauugcaugagcccaggaguuugagaccaguauguauaacauaccaagaccccaucucuuauaaaaauaaaaaaaauuagucagguguggugguacacaccugcagucgcagcugaggugggagagucguuugagccugggcgguugaggcugcagugagccaagaucaugccacugcacuccagucuggacaacagagugagacccugucucagacaaaaaaaaaaaaaaaucaguuaauaacuagcauuucagacauacgaguagaaaguaaaacuagaaugacaaauuaauguuuaaaaguauuucuaauauaagagguuagugggaugugucuuaaaguggaaauauaugauuuagagcuccugacauuuacuuuugagaaaauaauaaaaauuauuagaaauugagaauauauaguaccuauucuuuuuauaauuuauuuuaauacaauaaaauguuacuagaaauguuacuagaaauuugaaaauaauguuaguagaaaugugaccuaaauauuuggagagauauuagaauauauccaauggaagcagacuaauauagaaaaaugagcacucuacugugauauuugaggcccuggaucucccauuuugugaccuauggccaacuuucuaggcuguaaucaucccaucugugaaaugaagagcaugaccucaucauuaccauaguugcugugguguccuucaucucuaaaacuuaaugucugucuaaauugaaagcauccauaugucaguuucuaccuagaaauuugugguucauauauucauauagcuugaaggacuauauuuucuugccauuuauauuuaaaaugauguguaaucuacagacacagaguuuuuccaguagugagcaauauaguuagaaucuuuguggguacagguugcauauauuuuaaaauuguuaaugguugaguugagaagguuucaaaucucaaaaucucuuuacauuagaaauacucuuggcauaggaguaugacauauuacacauagugaauuaaaggcauaugaaaaaaugucuguuuaacgaaguaauuuuaguggaaguaacucaaaauuauaugaauauuguaauuccaaauuuaucucagcaggcuagcaugauuacuuagugguauuuuguuuuacagugauauaggagaacaaauaauuaaacuaugcuuaccacuauuucauagcuagugagguaaauuauuuucugaaaaucucaguugggccagucucugagccagauaugcuaacuuuugccugugggauuaugugauuuacuggggucagaauagucagguauuuuuauaguaggcaguuuuacuauaugcuauguggacaaauugaaaaugaaggacugaguuuuuuuuuuucccuuaaaucuaauuggagaugcaauacaugaaccuacaagggaacauuuacucagcagcauauuaauuagugccaauuuaaauauuugaugauugcuagguagcaaagaauucucuagauccugaagaauuuauggagaaaagauguuuugaauuggguuuuuuguggaugaggaauguauagaggcaaagauaccuaggcaaaagguaugcuugcuuacaggugauagagguaggagcuuuaguaaacucuaauucuucuucauucugagaaucauagauaaacuaagaaauacggcugaggccccuuaguaucuuuaggaacuucaagggaaaugugggaugugaaaaauaguacagucuguuacaauggcucaugccuguaaucccagcacuuugggaggcugaggcucgagaaucacuugaggucaggaguucaagacuagccuggacaauguagugagaccuggucucuacuaaaagccaaaaacauuagccaggagugguggugaacgccuguagucacagcuacucgggaggaugagaggugggaggaugacuugagcccaggagguggaggcugcagugagccgugaucacucuaaugcacugugugacagagcaaaacccugucucaaaaaaaaaaaaaaaaaaaaaaaaggcccaaaacaaaacaaaguacagaagggucacagccauauaucuaggcuguauaauuguuguuaacuaugugagaaacuuccugaagaguuguguggugagaauguaugccuuagggcaguacuacucauaaugugucaugggaccagugcuagucugugaauugucuguuaggagauaaacacugaaaauaaaugucuagagacuucuauaacaauuugauaauacugugacauucgaauauggaaucauuuuucuaauuaucuuuauuuuacaaaauuauaggaccaugauuuauaggagauuuuuuaaaaagugaucuuuuuugauguuugagaagcacugauuuucuuuuauuugucacauuaggaaugccuaauuuuauagagagaaaaaguaaccauuauuugagguuuguuaaaaauaggaguuaauauacaagagauuauuacaugaguaaaccuuaauagcaagauagauaaaauuaaauuugaccacuguuaugaaaagaaguaguuuugagagucacugaaucacaaaugugaucuagacaagcauuaaaauuuccaaugagaaauuauuugggaacaaaauaucuuuacaacagaguuagauauuggaauacagauauucauaaaugaagugauucagugcuaugauaucuugcugaugauucuugcuaagauagaaguguuuauguagggcaaccauguaugauugaggcaaaucccaggcaaaaugagaaaucuuucaaauuugugucagcuuggcuuucuccuuuuauaucuuucugggcuauugcccuucuucaucuucuuuuuuuauucaccuagucacauuuuuauucagcuucccccuacuucuuccauuucuuugguuuauacccaucguuuauauuucuuugguuuacuuuaguauguuguuucagucaauaugcgguuuuauguggauauuuguauuauauuuuuaauacggagauaacagauuuucacuucuguaaauuuuuuuaaguuuuaauaacaaguuaaauucuuugggguuaggaggcaaagacuuuugaaguaucauguuuaucucuucuguucuugcuuuuaaagcuuuuuguuaggacuagggaagugggaccaaagggagcuggcugguucgucugcugauagcuuauuuuugaggagaugugguugcuagagguacaguucuggauuauucugcuugagagaaaaauucaccagcaguacuuuucuccgcuuucuucuuuguuugaaccuagcuugggucucccuuuugcacuguuguuuaucuuaagagcacccaucucucucuguuacaaaacuuacugaugauaaauauuuuauguuuucugauuaacuugacauuuaaaaguuuucuuauagcauuuuuauucuaaagucuuccuuugaaaaaugauuuuuacauuauuucuauucuaggcaagcaaauauggaauaacaaagacuagagcauauuuacgguagaguucuucuauggaaaaagauaaaguaaauuuggagaaauuaaucugaguauagcauagacaauuuggaauguaaaucuuaauccuucugaugguuaagcuaggccuuuuuugcauauugaaucaaguauugaugucagaaaaaauaaaggagaaaauggagaagacauugaaaaauaacuaaaauuuuaaaggagauuguaaucuaaauuuaaucuguaaaaugacuguuuuuagguucuuuauguauguucucaaagaaauaauguuuuacuugguauuuagauuuccaguaagccacaucauuaucuuuuacccauugaguauuguucacuaauguuucuggaaaauuguggcgagaauuccaaauuaaugcccucagaacuauuaugcucugaaaucacuaaacauucauucaccuccgcuugucaagauggaggagggaaugugugccaucucagccuaagccaaguuuaggagagcuuuuaggcuuagagauauguuuuccuuuggaaacugacacaguuauuggaguccaaguucgggguauggggaagacacccaugugugguuccuguuuauagcuuacucagagccucuuggagaauuuuaauuuuucaaagaacaaacagcaggaaugauaauaacacggcaguguuggauagugguuaaggcuuuaggguuuagaguuagaugcgaggcagucaggauugaauuaguguugcuucacugauuaucuuugugucuucaacuuaguaaaccuuuuuguuucuucauuugcaaaaugagaaugugguaccuaguaaguaagguuguuuucaggacuaaaugggacauguugccuggcacagaaguguugacuauuauugguaguagguaguaagugguguuggucaaauuuugaacuuugcuuggaaauuguuaacuguuguuaauuaaguaucccuggcuacucacucuguaucaggcuguacuaaaauuguccucuggaaacgugguucuguagcugcucugaggaugucuaccuuuucuuugagauguucaggccuccuccucccccaguauuaauuuuuugccuucuuccucacagaaacuucuuccuguuagcuucucaaacauguccuccagaucaugugaaaauccauuggggguuucuugcaacauaauugcagacagauagaaacuugauuuuauuuauaugaaugaugauuuuccguauuuguuccagauaauaugguaaaccuaaauaauuauuuuauaaauuaaauguuuuauauuuuaucauaucauuuaguuacaucaacaguucuuugggagagauuauuuuuucuguuuugggaaauagaaguuugagagaucaaguaauuugcauagaauaauauaaauuacauagggcaauaugagaaggguaaguugacugaguuuacucuagggugaaaaauaggccacugguaauauggagaggaggagauaaaacaucguuuaaccuuaugccugcuucuuuuuccacuuaagugauuuuuuucaauguaaauuucugucaaaaugguuucuggggcaagaauagacaauugaauuuuuuauaauugacagacaacuuuucagaaauguagcacaaauuauauuccaacuaauaggggcugguuuuucuacagucuugaaaacacugggcuauaaaaaucuuuaauauuuuuguaauuucacaggcaaaaaacuucauuuaaauuugaugguguuguagacuucucuuuuauguuuauuggucauuaguguuauuuuauguccuuuucucauuuccuauugggcuauuuuuuaaauucauuguaagaggucuuuguacauuagagauguaaaucucuucugucacauguuacaguuucccuccauuuuguuauuggucuugaauuucacaaguaauuuaugcugucaguuuugaaaugucaugcuuacucuguuucucucauacuauguuuaaaauagcaaaauauuaagccaauuuuuguuaaaauaacauggaaaucucugcucuaaugaguuaguaauucgaauauaaagggccguccuuguuuuuauauaauuaauuugaauacacugugauuuuuauugugaaugaucucuaguaaucaguuucccuuaguaaauggcuauguguucucucuuuucucugcuuuuuaacugguaggcuugaauguucuuccuguugguuaucuccagucucagucuauucuuuucuuaaaauauacaaguaacauuagauugaaacuugcuaaaaauaugguaguucuuauagagaaagacuuugagaguugacuuuucuuuccugcuaaguaaagaguauucgugguugaguuuccaggauuggguugagauaaagauguacuuuggaaagaacagauuaaauuuuguuuuaacaagugugagguucaaccauguacuuccuguacuuuauuuuaauuggcacuuugugugcagcgaccauuuguuuuuguuuaauccagaaaacuuccuccaaauucaugauuguaggagaauuuuguucuguugauugauuuuuaaaaagagcucucaugaguuuguuuuggaagccuuuuuuuuuaaaggugugugugguaguaugguguuugaugcuuuaucauauuuaaacgugaacugaaauuuuuuuaugccuuuuauauacaguuuguaauacuguuggcuguacucaucaucuaauuuuauagcuuugaagauuuugaguucuuauacacaguaaugguaguuuaaguaaaaccauggugcauuuaucucuugaaccuacaaacuaguagaucauucuaagguuagcugguuggcuucuuuacacucuggucauucuauuugcgaaguguaguagcugauauuuaggggccuagcauuauugauagcucaucccuauuuuccuaggagguagguauggggaaugaauuaguaaaggugaacuuaaaauucucauccacaaacaugcuagccuaagcuccaaauuaaauguaaccaaaaccgugugguuuuccccaacucuguuuuauucccaagauuuguuguccuuguauuuugaaaacggggaaggagaacuuuuaaauucuaguuauuugaaugaagucuuuaucaguucucauugauuccauccaugcuaauuaaauacaaaaauauuucuucauuuggguauauguauuuuguuaucuuagguuuagcuagaaugacauuaagauuguaauguguuaaggaguauuacagaauguggaauugauuucuuugaguuggauaugagauguuauaguuaagaguacaauuguuggaaccugacccuauguuaauuuugagauaauaggcaaguuauuuuaaccuucucucagacuuacuuuuaucaucuguaaaguugguauaaaauaggcgcuaugucccagaauuaugugaauuaaauacauuaauggauauaguguuuauaaugccuuguacuugucaaaugguaguuauuguuauagucuccuauuuaugaucugcaauuuaaaaguuuguuuaucuaauuauguacaagacgacuuuucauuauuuaccaucuuuguuuaaauucaauuauaauaaaacucauuucugaaaaaguguacacauacaaguuaaauaaaauggaaaccuuuugcuaagaagccaguagacauucuggcagcuacauagugacagcuacaugggagacugaggugggagguuugaguucagggguuugaagcugcaaugagcugugaucgggccacuguguuccagccuggacaacagaacaagacuguuaauauaaugaaugcauuugguaagggacugaaauugauagaaaacuuuaaugaucauuacaauugauagauuaucauggaaauaacuuucuuguuuaaaaaaauaaaacuggccuggcaugguggcucaugccuguacuaucaccacuuugggaagaugaggcaagaggauugcuugagacuagccugggcaacaugguaagacccgucuuuaaaaagaaaaagcccucgugagaugacucacaccuuuaauuccagcacuuugggaggcugagguggguggauaacucgaguccaggaguuugagaccagccugggcaacauggcgaaacacugucucuacaaaaaauacaaaaaugagcuugacuugguggugcacgccuguagucccagcuacuugggagacugaggugggaggaucaccuaagcccaggagguugagguugcagcgagccguguuugcaccacuucacuccagccugggaaacagagcaagaaccugucucaaaaaaauacaacaauuuuuuucacucaaaauauuuuauuaacuuuggcaugcuauuuuauuucuuuauaucugguacguauugugguuccagucuaaagcacaaggauauaagaaguugcaguugguguuccaguucuuuagaaauugaaugugcccuugcauagcaaggucuuccaacugauuuuauuuuugguagcauaaaaucccuuuguaacacugagauuuuaagaacauaaguaaagacugcuuuguagacuuccuuaaauuacuauguagauaauguuugucccccucaaugaccugacucauagcagaagcuacaaauacguguauauguguuuauacauguaaauuauguucugcuguguuugauauaauuuauuuuucucauuuuuuacguauuuuuguuuuuugaggggcagugucuugcccuguuucccaggcugguucaaacuccgacuucaagugauccuccugucucaucuacccaacuuagcugggacuacaggcacaugccaccaugcccagcuaauuuuuuaaauucuuguggagacugggucucacucuguugcccaggcuggucuugaacuccuggucucaagugauccuccugugucagccucccaaagugcugagauuacaggcaugagccaccucaccuggcccaaugaaugauuuaaaugacacuuuaaaaugaucuauguuuuauuaaucagaacaucuuuacaaacuugaaaaauaguaguauacaaaugugaaauaucucuuuucagacacugcuuaaacgaguauaugaauuuauuuucuuuuacagcaucaacucagcagccuaucuccugacacuccuaagggucuuagguacaucaauugagaaaucucuggccuaggauuuauuauauauuuauuucaaaauaagccugcauuuuuuuugcaaccuccucugacuccuaaugagcuucuuucuguucauuaaauauccugauacuuuagcauaucugcaauuauaagaauuaaauaucaaauuauaccauuaaugauuagugguuaaucacuugaggccagguguuugagaccagccuaggcaauauagcaagaccuggucuccacaaaaaauuuuaaacaguuaauggagcaugguggugugcacgcauagugccagcuaugugggagacugaggugggaggaucguuugagcucagggguuugaagcugcaauuagcuauaguugggccacugcacugcagccugggcaacagaagacugucuagaaaaaaaaagaaaaagaaaaaaauuacauuguuucagaguguaaauagugaaaugauuacacagugauuauguuuuugauguucaaaggagguuuuuauaauucacggcauuggaaacuuuuuguccugaagcaacaguuuucucuaguuuauuauuaaugaguagaccaugauauguaauaacaugugacugauaaugugaggcauuuuggagauggugcuguuuugcaauuaccaaaagaauuaaaugcucugagaauuggucuguuacuuaguagcuuuaacuacauuuuuuauacaagugcugguauuuauagauuguucuucuagcugcacucugaacuuuuugggagaagagaauagaucuucuugaucauuuuauuuuuaagaaugauagagaaguuuauacugaaauguugaguaaaucaaggaaugaaaaaauauacauguguguccuaaaauuaccuucuguucuuuccuuugacauagugagucuagaggcuuaccucccuuguaaugagaguggacuucccuuagcccuaaaccacuggaacuggcuuuuaugaaguggggcaaagguuuuuggaaaagcuagggcuuugagggcuacaaauagugaucuuaaaagcucucaguguuagccaggcgugguggcucacgccuguaaucccagcacuuugggaggccacgccggguggaucaugaagucaggaguucaagaccagccuggccaacauggugaaaccucaucucuacucaaaauacaaaaauuagccagaugugguggugggugccuguaaucccagcuacuuggguggcugagccaggagaauggcuugaacccaggaagcagagguugcagugagccgagaucaugccacugcacuccagccuggggcaacagagugagaccccgucucaaaacaaaaaaacaaaacaaaacaaaaaaacucucaguguuaagaucaagcuccaagggggcaaggagcuacaaggacuugcgaugcugaauuuuuaaaccccuaccccuuuucauuuugaggagugacuccaauuucuguuuguaucacuaguuauuucuucuccagaucucucugacguuauugagaacuuuaguacucaaagugcgaucaccagaccaggagcaucugcagucuugggagcgucuuuagaaacacagauucuuagaccucgcucuaaggccuaccgaaucauaaucuuuuauuuuagcaagaucccuggaagauuucuguguucacuauuguuugagaagugcuacucuagaauauauuuucaaaccuuuucuucuugaaaacuuuuauucaagccuugagcuuuuuuguuuguuuugauauuuuacuuuugagacagagucuugcucuuaucacccaggcuggaguccaaugacacaaucuugacucacugcaaacucugccccccggguucaagugauuccccugccucagccuccagaguagcugggauuauaggcgcguaccaccacgccuggcuaauuuuuguauuuuuugguaaagaugagguuucaccauguuggccaggcuggucuggaacuccugaccucaggugauccgcccgcgucggccucccaaagugcugggauuacagacgugagccaccucaccuggccaauuuguuuguuuuuugagauagagccucacucuguuggccagguuagagugcaguggcacagucauagcccacugcagcuuugaauuccuggguuaaagugauccucucacuucagccuccugaauagcuggaauuauaggcacaccaccacaccuggcuuauuaaaaaaauuuuuuggcggggguggggguagagauugggggguucucacuauguugcccagguugguccuugaacuccuggccuuaagcaguccuccugccuuggccuuccagagugcuaggauuacaggugugagcugcugugccuggccucugcuggauguuuuaccacgggaaaagggguguauuaguccauuuugacacugcuauaaagaaauacccgagacuggguaauuuauaaagguaagagguuuaauugacucacaguuacacauggcugagaggccucaggaaacuuagaaucaugguaagugauaaaaccaucagaucucgugagaauucacucacuaucacgagaauagcacgggggaaaccacucccaugauucagucacucccuuaacacaugggcauuauuaauauaauuugagaugagauuuggguggggacacacagccaaacuauaucaaggggauugggaauuuuguuauacaauguuaacuuacacguguggagcacaaaagcugguuaucaauaggauguggcauuuucaaaugcuuuuauuucauaauaaccagcaagaugggacuggucaggcuaucaagaauagaggaucaauaagggaauuuaccuuuuuugggggaccacuguguucauaagguuggucuagguaaggauuucuagaagcucggaagggaagaggaguuggugcuuuuguuugcucugaaggaggggcuuggaucuuaaagaacugaaaaaacuuuaguaaauaaauauuucccuuaaaauuguguuugcccuguuuauuuucugaucuucucuuuaaccucuuccuuucccuuagcaccugcuuccaguuaaucaccaauagugguuuuuaaccuaccagauguugccacaaguaagcuuucacuaguucucuauuucuguuauuauugccucaaguucauauccuucuuucucgacuagugauucguagccagggcaguugugucuuuuuacccccagagaacauuugguaauaucuggagacauuuuugguuguuacaacuggguacuuggugcuuagugguauuuagugggaggauagagaugcugcuaaacauccuacaaugcacaagacagccccccacaagaaagaauuauccaaagucaguaguacugaaguugagaaacccuaaccuagacuacugccagaguccacuaauuugucgaccuauuuccacuuuuacucccucuuccccaauucuuccuccacacugccacagaccuuccuuucuaaaauacaaaucugauuuugucauuuauucuuuaccauggaaugauccucagauuccuuagcuuaggaaacaauauguuuauauuuacuuauuuauuuuaauuuuuuuuugagagaugagacaugucacugcagccuugaccuccugggcucaagcgaugcucccaccucaggcuccagaguaggugggacuauaggcaugggccaccauacccggcuccuuuuuucauuuuuuguaaagauggggucccacuguguugcccaggcugaucuugaagucggcucaaacagugcucucaucucugccucccaaagugcugggauuacaggcaugagccacugugcuuggcacuaaaacaauacuuuuuuuuuuuuuuuuuuugagacugagucucugucacccaggcuggagugcaguggcaccaucucagcucacugcagcggcaccaucucagcucacugcagccuccgccuccuggguucaagagauucuccugccucagccuccugagucgcugggauuacaggcgccugccaccacacccagcuaauuuuuguauuuuuaguagagacaggguuucaccauguuggccaggcuggucucgaauuucugaccucaugauccguucgccucagccucccaaagugcugggauuauaggcgugagccaccgugccuggccaauacuuuuuaaaaauugcauucaagcuucaucuuuuguucucaaacuucaccuucugcuaauggugaacugcauacuugugguuuccucuaaacaccaucaugucuguauacauaguuuuccccuaaccuauacuacauacuuccaucucauauuuuccuaucuaggcacauuuauucuuccuucagaacuuuacucaggcauucacuuuucucugugaagcuaccuuuguuucugcucuauucauacaugauuacuuaugcauuguuauaucacaguggguugugguuuguuuacauuucuguuaccuccuagccuuuaaucugucuucgagcguaagguguguguuguguuccaaauacuuagaacaguuccugauacaaaguagauucucagauguuuaguugaaaguacauuuuuuucuucagggauuaauuaguaauuuggaaauuagcuuauagaugagauauuguuauaauuuacauucuaugcaauaaaacuuuucuauguaaucuuucgccucaccaucauguuuuacauugcuaccaucucuuuucagauguuauuuuguauuuugucgcuuauaaugguaccuuaaauaguauugauaccuuagggcaggaguguccaauuuuuuggcuuccuugggccacauuggaagaauugucuugggucacacauaaaauacaccaacacuaaugauagcugaugagcuuuaaaaaaauggcaaaauaaucucaauguuuuaagaaguuuacgaauucuuguugggccacauucagagucauccugggccucugguuggagaagcuugcuuuaggauauuuucauuuaguuacacagagaagauuuuacuuuuggauuagaguuuaaucucuggcuauuuauugaaaaaauuuaggguuuauaauggcacauguuuagagaucucuucuaccuauugaggagaggcuuuaggcuaguuaaggguuuuagggcauggaguggaaggagaggaaugaugaauucccuuuuugaaaugaagaaacguaauuuaaugagugcaguuaaagagggaggaugauacguuggauguauuuaaaaccauuuuuggggacgggcacgugguucacgccuguaaucccagcacuuugggaggccaagacaggcagaucacuggagcccaggaguuugagaccagcuugggcaacauggagagacucccaucuccacaaaaaguauagaaauuagcugggcguggugguacacaccuguagucccagcuccuacggaggcugaggugggaggaucucuugagccugggaggcagagauugcagugagcugagauugcaccacugcacuccagccugggagugagacccugacuuaaaaaaaaaaaaaaaaaaaacccaagaaacaaaaacuaaccaaagagcaacaaccuuuuuuuucaauguuguuuacuguacuacuacauagaaagugaauuguauugacuguaauaacugugucaaaaguacauuugaggcccagugcgguggcucaugccuguaaucccagcacuuugggaggccgaggcagguggaucaccugaggucaggaguuugagaccagccuggccaaaaugaugaaaccccgucucuaauaaaaauagaaaaauuagccaggugugguggcaggcgucuguaaucccagcuacuugggagacugaggcaggagaaucaccugaacuagggaggcggagguugcagugagcugagaugauaccacugcgcuccagccugggcgauggagucucaaaaaaaaaaauaaaaagagacacugucucaaaaaaaaaaaaguacaucugaauuugugaaggaucugaauuacggaagaccuuuuaaaauaauuuucaugcauucagauauaugaccuggaauuuagguguccauguauaaaucauuugacaaccugagauuuugauuaaguaaacguucuuugauauguugaacuuuccugauagaacaagguuaauuuuagcucagaaauuuucuuaaauuuacauauauguguguguauauauauacguguguguguguauauauacauauauauguauguauauauauauauauauuuuuuuuuuuuuuuuuuuguagagacggagucuugcuuugucacccaggcuggagugcaguggcgugaucucggcucaaugcaaccucugccucccagguucaagcaauucugccucagccucccaaguagcugggacuacagaugcacacugcuacacacggcuaauuucuuuuguauuuuaguagagaugguguuucaccuuguugcucagucuggucuugaacuccugagcucaggcaaucugcccaucuccgccucccaaugugcuaggauuacaggcaugagccaccguucccggccaaauauaaauuuuaaauuaguaagugucuaauuaggguuauauuacuguaugucagagccuuguaguuuucuauuugaacacaaaaauguacaauuuaauucuuauacucuuuccaaggaauuaaguuacuagaaauaacuugcuuuaaaauucuuucacuuauaacgugguuccauggcaugaaucacuaaggguacauacuuauucuuauucacaaaauuucccucuauggcuuuucuaaaguaugauagcaaauaaaaaaaaauguucccuaugcuauagacauagagaguaacuagauugguucaagauugcauaaagguggagguauguuagucucauaaaacucuguucguuaggcugaugugguggcucaugucuguaaucccagcacuuugggaggugguggauggcuugaguccaggaguuccagaccagccugggugacauaaugaaaccccaucucuacuaaaaauacaaaaauuagccuggcgugguggcacaugccuguagucccagcuacuugggaggcugaggugggagggucguuugagccccugaagcagagguugccacugagcugugauuguaccacugcauuccagccugggcgacagaaugagacacugucucaaaaagaaaaaagaaacaaaacucuguccacugccauaauuauugaguaaguaggcauucuaguuaccuuucucaaugcaaguuuaguuauuuuuguccuuguuuuuuuuuguuauuguuguuuuuuauuguuuguuuguuuuuaaauuugggauggagucucacucuguggcccaggcuggagugcagugucaugaucucggcucacugcagucuuugccuuccaggcucaagugauuuuucugccucagucucccaaguagcugggauuacagacaugugccaccaugcuuggcuaauuuuuguacuuuugguagagaugggcuuucaccauguuggcuagggcuggucucgaacuccugaccucaagugacccaccaccucggcuucccaaagugcugggauuaaggcaugagccacugcacccagccuuguccucuuuaaaucaaagacaguauagcagaugcacacuuguggaguggagaaucuaauuugcauggaauaauuuacauaggcauuauuugcaagauuuugaaauuuggaaauuaugucuuuuuuaaauugguucucuuuauacuagaaaacauuauuaauauauuugacuggcuauagguuuuuuuuuguuuuuuuuuuuuuaauagagacagggucuugcaauguugcccaggcuguucuggagcuccugggcucaagugauccuccugcaucaaccuccaaagugcugggauuacaggcaugagccaccaugccuggccagcaucuuuuuuugaagaaacuuaauuuuaacucuuuguuucagcagucuuauaccucaugacagaacaaugaguaaacauauauuuucuuauuucagaguuuaaauuaauuaccuuccuaagcaugaauuaguguuuucugaagggaaaaaauacauacaaguuuuccuuaagaugcagucuagugcaaauuugcuguaauuaagagaagugagauaguggaaacaagcacuaauuuucaugaauaaaaguccugcuaaccacuauuaagauagcuuauuaauuuucuuauaauguuaggcaaauaauuuaugauuuuauugaauaauuuauucauuaucaaucuguucauauuauugagauuuaaaagaccaauuuguguuacuguuuuguuguuguuuuuuagucugagguuuuuuuuuuucauugaauacuuuagggugaaugccuauuuaagauagagugaguuguacucaagucuaacgugcauagaauuaaaauuuuuuaaaaaucaauuuauuaggaaacaacugcguuuuuaaaaguggguuaguucucaguaggaaauaaaguaacaagauggugagcugaaaaaguuguaguuuggcgaacuuuauaaaaaagaaaaaucuguauucuguguccuugaaaccauuucuucauauugcagugagaauagguaagugacaguagaaaaaauuuugcaaagcauuuuucuuugcugauaaguuaaauuucuauucauuaaguaaagucguauaaaaucagauuaaauguauuuuucuaaaaacaucuguugcuuuauauaauauucuuuagcccauuaggaguguggguuauuuuggagguguggguuuggugcaggggugggaggugguggguggugguaaggauauuagaaggaguguuuuagaaacuuguuuccuaucccaccguucccaguauccuguauauguuaguuauguuaguuuagauuagugugggggauguuaggaguggccugguuucuuuccuucuuuuuccuagccaaggaaguaucgccuggggaugcuggaggagaggcuaguuccgaugggaucaaaggcacgaaaagcaaagaacccuauuggcugccuugcugacagguguaaaucaggaguacccaucaauaugguuugguggaacagagucacagaaaacaauuuacagguaaaaauaauuuuuauuagacauuucuugaaagugaaugucuuggcugcuuucugugucuguuugggguggugguugugaaaggauuggaugacuuagcugguauacuuagguaauuaaaaaaauuuuuaaucagaauaaaguuagugacccuuaaccaacuaaaugauuuuuucuugguggcuuuuugagcuuuuccucuuuguagaauauuuuacuuuuguuuguuuguuuuuuguuuuuucagacagagucucacucugucccccaggcuggagugcaguggcaccaucuuaccucacuguaaccuccaccucccagauucaagauaccaugccucagccucucaaguagcugggacugcaggugcacaccaccaugccuggcuaauuuuuuguauuuuuaguagagauggggucucgccauguuggccaggcuggucucgaacuccuaccucaggugaucucugccuuggccucacaaaaugcugggauugcaggcaugagccaccucuccuggccgaauauuuuacuauauuuaguuaaauuuaguuuuucuguuuucaauuuuguuaauacuugaguucaauuauuuuuacuacccaagaguuauucaggauaggacuacauugaagagucauauaaggccgggcaugguggugcacgccuguaaucccagcacucugggaggccgaggaaggcguaucaccugaggucagaaguuuaagaccagccuggccaacauggugaaaccccgucucuacaaauauacagaaaagaaaagaaaaauuuuagccaggugugguggggagcaccugcaaucccagcuacucgagaggcugaggcagaagaauggcuugaaccugggaggcggagguugcagcaagccgagacugcaccacugcacccacuccagccugggcaacagagcgagauucugucucaaaaaaaaaaaaagagucguauaaaauuuauuacacaaagucacauuuauuuggaaaucugaagaacaagaugcuucauauguugucuuuuuaacauuuuuacuaggaaacaaaaauuauauguaaacaaacuugucaagaguugcucuaaaacuaacuucaauaguauguugucauagagucauuacaaauacauuccaucuuugacuguaccuuuuuugucaauacugaauaaugcaaaugaaaauuuaugucagguaguuucuauauaauauuuugaaguaccaacaaaaaaauuuauaugccauuuuaaucuggauuauaauuuuauuuccauuuuuaaaaaauugauaauuauucuguaauauuguuuuauuaaccaaauuucaauuuagccagagguagaaugucuuuacucccaaacuugcauuuaaaauauaucccaaggcaaagccuauaaucccacauguacauaccacacacagaaaagauauaacaaagguaacaaauugguuuuauuucuguuuccaaccuuauguuauaaauagguuccacaguauuuuguucuguuuauuacugauacaugaguaguaucuguauugccuugggcauaggaauaaauaaauuauuccaaaaguaaauauugcaaaauguaguauuugcuccagcugauauuuugguaauauuuucuaaagauaagaaaagacagggguuucauauaaccauaugcuucaaauuucauuggaaaguuuuggcuaugucaauuaugaauaacaguauaguuuuuuuaacugaauuugcuugucuuuuauaucaguaguggagagguuuuugauacggguuguuacaauuaguuuuuaguuuaaaaaagaaggucugaagaaaaaaauuggaccacagcuauuuaagagcagauacaagugaaauuggaauuacuuguagguugugggggugaaacacuuaccaaugcagagguguagccacucgaccucuccacgacugcccccauuauccugguggcaguucugagguacuuuuuuuuuuagaauagcuugaaaaaucuuuagguugauuauaguuauguuuuauuuauaauuaaaauaguaauagauuugcauuaaugugugaaauauugaauugguguuaucugaaucuaauguuuccaauacuguuauuuuauacuucagguaguucuuuuccuuuaaggacauaaggaaugcuguacccaaauuuagagcuuuauaaucucuaaaauguuucacuuuaccaggcacauguugaaguacugaaaaauacucaucucgucucuauuacugucuguguagauuccaaacugggggucuggaauaguuuauacaaagcaaauaguaugucaauauauauuuuuguauuggaguuuuuaucuuuuucuugugagagaaaaguaacuuaccaauuccauaccauuuuuuuuuccuuuugugugauuagaaaguauuuuuaauaucguuuuguguuuucgacauauacuaguuaaaagaauugugucaggagcauauucaucuuuccuguuccauuuguuuccuuaaaucuuagguccucucaauccuagggucagaaaaauguuuuaaaauauuuuauguuaauaauuauggcuauguuucuuuaaugguugucuugugccaggcacugugcuaagcucuuuacgcguauugucuuuugguauugcuaauagcuuaugggauagauguuacugcuagaugaagaaacaucuucagagaagcuaaguagcucuaagguuaaacaguuaguagaggaacagauauuugaguccacuuuugucagacucaaaaucucuuuacuucuaugugcuguagcucuaguaacuacaguugguuuaauuaucuaacugguuaacugaauuucugcaggacagcuuuugaggaugaggaugcauccauaguuguauagacacgggcuguaacuuacguaugacucugcagcauguaagcucugucauuuuuccuugugcuucaucuuuuuccucugugccauuuaacuacuuuucuuucuggaacuuuaaacauuccuuuacguucauuucuuaaucuugaccuaacaucuuggucuuuuucuacuucugaaaacaaaggaaaaccaacaaaccaacuaacaagaaacuuaacaaaaccuugguccaaguuuccgagcucugauggaaugcagucauucauacugcauuuauucucuucagugcuggauuucuuucaagaggcuuaugauucccuacccuuuauuacuuaguaaucuuuuaacugauuuuuuaaccaaauacuuuaugauacgaaggagccugucugccaaacauggcauuuauuaaacagugauacauuugaaaaauacauauguggagcugcuaauuagagaaacagagaagcuuaaaauuuuucuuaaucuuuuguacguuuguagaggguaaauuuauucuucauauggcuguuugagauauugauaagacccaucugaucuccauuaauauguuuguaaaguccgcagucgggaaccuuuggaaugguuuccacucuuuucucuaaauuuccuuaccauccauuuacuccuuaaaugucugcaaacugguguuaccaaaauuuuauugaaauugcucucagaguuuuccagggaucuccauaauugccaaauccagcaguuuuauugagcacuuaauauugcuggcuacuuuuuuauugugaaacucucucugucucucucucucuuuuuuuuuuuucgagacagggucucuguuacccaggcuggaaugcaguaaugcaaucauggcucaccucauagucucgaccuccugugcucaagcgauccuccugucucagucucccgaguagcugggacugcaggcacauaucacugcacccaccuaauuuuuuuuuuuuuuucacuuuuuguaaagauggggucuugccguguugcucaggcugaucuugaacuccugggcucaagcuauccuccugccuuggcacgccaaaguguugggauuacaggugugagccacuguacuggccaugaaauuucuuucuuugcauuuuuuaauaaaaaaauuuuuauaauacaaaaaauuagccgggcaugguggcgggugccuguagucccagcuacuugggaggcugaggcaggagaauggugugaaccugggagguggagcuugcagugagcagagauugugucgcugcacuccagccugggcaacagagcaagacuccaucucaaaauaguaauaauaauuuuuuuuuuuaagagacgggggagugggggucucacucuguugccuaggcugauuuugaacuccuggccucaagugauccuuccaccuuagccucccaaaauacugggauuauaggcauaaacgaccacaacugccugucuuuguacuuuuaacucuuuguuucgucccuggcuccaugugagcuccuguucuugguucacuuguucuuugcuuuuucuuguaugucauugauucugaaauguuacuuuuagaauugucuucugaguucaaggcucagauuuucugugccucugauaccuuugcauguggguaaauaugccacucucccuacaaaucuggaaagucuagaaauacgguuuaauuuuugguuuuccagauuuacugcuucgcauauauucuccuauacuccuucuucaguuuauggcauuaucuucccuaucucugagacuaaauauuccuuccuugccuucucuuucauucuaccucuuauuuuuuuuuuccccccuggauuacuuuuuuaaucuaacacuuauuauaagaaggaaacuacugugcuuugacagaucauuaauuaaaauagaauauauuggacaguguacauuauaacaauaaucacauauuauccccauuugacaacagaauugggccuuaggaaagcuuaaugcugguuagugguagagcugcaauucuagccaagaucuguucuaaaucuugagauuuuccugcuauauuaucugucucuaauucuuacuuuuuuaaagucuacaguaucuuaccccucuucccuuuuuuauaaauagugagauuguuuauuccuuacgcauauacagcuucugaauaauuuuugucaauuuuuuuuaggauuuauucuaccuaucugaguuuaucucuucauauccauccauauauacuacauccuaaccauaugaggucuuuuauguuacauaaaauauaaaauacauugucaguucucugaaccauuguuaacugagccugaaaaaucuuccuucuuuuuccuuuaagagauggcucaaauacuacuuucucugggauuacuuguauacacagcaggcaggauagaauauauauauguauacacacacacacacacacacaauuuguuuaacuuacuuuacuauuccuaguguauuugguguuuuacaguuacuucauucuguuuuguauuaaauuuguuugccuguuugucuuuuucuacuggauuguaaauacuugagguuaagcauguguuuauuucuguauccugaagguauuagguuggugaaaaaguaauugcgguuuugccauuacuuuuaaugcaaaaacugcaauuacuuuugcaccaacccaguauuuuacuuguuuuuaaaugcuacuguuuaauuuuuuucuuucuuucuuucuuaauuuuuuuuccccccagacagggucucacucuguugcccaggcuggagugcaguggugcagucuuggcucacugcaaccucugccucccaggcucaagcgaugcucccucuucagccucccaaguagcugggaccacaggugugugccaccaugccuggcuaauuuuuuuuuuugguagaaacaggguuucaccguguugcccaggcuguucuugaacuccuggccucccaaagugcugggauuacaggugugagcugccaugccugaccuuaauuuucuuuuauuggguaauauauguaauuuugugguaauuuauuuuaagacuuuucuauauuauuuauuuauuuacuuauugagacagggccucacucuguugcccaggcaggcaugcagugguaucgucauggcccacugcagcgucuaccuccugggcuuaagcaguucucccacuuuagccucccaaguagcugggacuacagguaugugcaacugugcccagcuagguuuucuuuguauuuuuuuguagagacaggguuucuccauauugcucaggccggucuugaacuacuggacucaagugacccacuugccucagccucccaaagugcugggauuacaggugugagccaccacacugggucuggcuuuucuguauuuaaaaaaauuaaucauagacuuuuuggggcuuauuuugaaauguuagagaucuuccaucuuaaaguuuaacauuauccaaguauucuugcuauuuuuuaaucuuuuaagccuuguaauagacuuaauuaccucuugacaguguuguuuagugagaaagcgucucugcuuuucuuuuuucuuuucuuuuuuuuuuuuuuugagacggagucuugcucuguugccaggcuguagugcaguggugugaucucggcucacugcauccuccaccuuccagcuucaagcgauucuccuguuucagccucccgaguagcugggauacaggcacacuccaccacgcccagcuaauuuuuguauuuuuaauagaaaugggguuucaccguguuggccaggauggucuugaucucucuaucucuugaccucgugaucugcccaccuuggccucccaaagugcugggauuacaggcgugagcgaccacgcccgaccagcuucucuguuuuauauuuuuuucaucaucucagcccagacaccaagcagguggugaauggaagaucaccugagacaccacaucaaaaacacuucauuucaccuaagugcaaauucacuuugaucuuuccuuuagucuuugcccaggauguuuaccuaucacuggaugguuaccugucacuuugccugaccaaucuguaugugaauucaacauuuucuauuuguucuaugacuacauaguucaaauugccauugcuugggcuugaaauauuuuaucaccuguccuacagaguuguugugaggauucaaauuuccaagcacauaauagauauuaaauaaauguccauuguccaguuuuaccuuaucaccuuaucuccuaaaguugauguuuguuuauauuuauuuagaguacagccugcaguuauauucauaugugcuuaaaucaugauauguguauaauggggcagugacacuuggucucuuuuaagggcucacauuuaaaugcuaacucacuugaauauuuugaaaaauaaaugcuuuuuuugaaaggacaacuuaauguguuuuuuccugugauuuuacauuucauuuugaaugaaagguucugggaaauguaugauuuuguaaauuucucauaauauugcagguuaagauuuaccuaaaaguagugauacauuaaauaaaaucacgcuaauuuugucucagacuuuugaaaauugugugguugugaaucauaaguuauaauauuacuauuguuuuagugaagugauacaauuaaauaagaacuguuggacugugcauguguuaggggauccauuugauuucauugucuccuugucagcaucucuuuugaugcuacuuuuuuccccuugucugauuaaauggcauuuuuuguaagagguauuuaauuauaagaaugcuuacauuaaaaucucuuggccuauaaauucucaugugaguucuaguugcuuguuacugcuuccuuuaagaucucgggggcggugggugguuggaaacucacuagauuuacuuccgucuuuacucacuggguuuugguauuacuucaggugauuuguaaucucuaggccacaggaaaugggauaauguaggcuuuugaugcaauggauuggacuuuguaaaggugaagcuucaagcuaucuacuuagggugccuggggacuuugaagaguuauagaacuaugaugcagcugcaguggccuuucuguaaauguacuacuuucuguucacacaucucacccuggaccuccucuucucucuagcugauacucgaaaucuuuaauguucucagaccuacucaacccuuacucuaucacuuuagaguaaugaccuuguguucuucauggaagggagaaaaaaggucauuaagaauucauugugguucugucuacugugacaaaguuuaaaaauuuuagaaagaauaaagugugggcugggugugauaacucauucuuguaaucccagcacuuugggaggcugaggcgggaggauucacuugagcccaggaguucgagaccagccugggcaacauagugagaccccugucucuacaaaagaaaaaauaauaauuagcuggguguggugacaugugcuuguagucucagcuauucaggaggcagaggcaagagaaucccaugaguucgaggcugcagugagcugugauugcacuguugcacuccagucugcgugacagagcaagacccucuuaaaaaacgaaaacaaaaaaacuguuucuuaaaaaaaaaaaaaaaagaaaagaaaugccucauguaucagcuuucuaccuaucuauauuuucauuaauauucuuauuuuuccuccugucucagacaaauagguguuuguuauauacugaaggccaucuugauuuuuuuccagcaacuuauuccuucaugugucucuucaauauuacucuuauuucucuauguugguuacauccucuuaacuuauaagcauuccauguuuaaaucuuuucugauacuuuaugaaccccacaacaaagcaugcuacaugaggaaaagguucuuuggucaguacauuuggaaaacucugcgauacaauuugggaaaugguuccuacuuauuauggugacuacuuuuucaccuuuuguucaucccuuaauucccaauauuuucccuuuccuuuucaccauucuauugaaacuguuuuugauaagaucgucuaacugacuuuuuuuuuuuuuuuuuuuuuuuugagacagaguuucgcacugauucacccaggcuggagugcaguggugcgaucucggcuuacuauagugucugccucccagguucaagcaauucuccuaucucagccucccaaguagcugggacuacaggcugcaccaccacacccggcuaauuuuguauauuuaguagauauaggguuuugccauguuguccaggcuggucucgaacuccugaccucaggugauccagcugccucagccacccaaaguacugggauuacaggcgugagccaccacacgcggccccuaacugacaaaaucaacggcauuccucuuacuugcccucugcuacaauugacaguugaccauucuucuuuuuuugaaacuuuuauuuucuuagcucuuagauuguuauuaguggguuuuuuuuuuuuguaagacuucuuggccuuuguacugcccucaagaacucugccaagcucugucauugacuguuuuuucuuucacucuuucuucauagugcucuucuguaaucucacaugucuucaauacuucagcuccuuccuagucacauuugacuccuggauacuuuuuuccccuccuaguccucugcacucauucuauuauauuucugguuucuucugaacaucuucaucuccaugacauaggacuuaaaacucaaccugucuaaaaugaacaccaaguuagggauccucccccucucacagaggcagggcggguuccuguaaaaaauaaaaauaaaugaauaaaaaauaaaaugaacgcuguauauuuuucuucaaaccuguuuuucauuuacacacaucuguagacacuuauucacaacuauaugccaccauauaucuugguuauugauaucauuuggugucuaacuugugagcucuuuuugaccccucacuuccuuaccugccauauccuucagcaacuaagaucuguugcugguuugaaauuauuuuuacucuguuaguuauaauguagauccaccuuuaauucuugcuuggauuauuauauuguggugucuuagcugguuuccugcuucuagucuucuuuuucaaacaacuaccugauugucugaucuugccucucaucuuugucauugggggaaaaaaggucaaaaucccuuaugaaggcauccaagcugcuccuugcucuuguuccuauugaacuauuugugguaccauguagcuaccaugaagaguuccauguucuugcuucuccuuuggcuauucuuuuugaacauucaccuugguugauguacccuuccuucugucuugauuuagcaaacuugucuuuuaagauugaauucauacauacggucuuauggccuaauuaaacagcauuagauguuugcucacauuguccuagcacuuaccagauucuaauuauucauuuauagaacuuaucacauaaacuaauaucaauauacugaucauggcacauuguagauaauauaugucuuuugauacauggauguucugaguucuugagaguguggaauuggguucaggauacauuguauaccugugaaaugucagccugugaacuuguagaacacagugucuauguuuuaugucuuucuuccucacagcgccuaguacacugccuugcacagugucuuuuauauauuagguauucaaauaauuaaauggauggaccuggauuauugauuagcuggaugaauauuugaccuaauguguuccugaaauuuaaugcuuuacauauuuuuguaaauuuucccuugguacaguuucauuaaauaaaauaucaacguggaaaauauuugaaaaucuuaauauauguuaaaauuuaugauuaauaugguaggauucuuuguuagaaagaauacaucuaaguauuauaaauuacuguggaauaugacaaauagguuuuacuguuauauggcuauggauagaagauaugcauaaguagcaauaaucguagcuguguaaaguaguucuugccucuuuggaauguugugauagucucacuuuccuguacuacuuauucacugaccuaaguaaacauuuuuccuccuuuuagggacagugauagaauaaacuaggugguaugcccugugauuaugaauuauuacuguuauuggagcacuuuuacauguaaauaacuucagauucuuuuaaguacagguucaguauaccuuauccaagauacuugagacuauaaguguuucagauuuuuuuuuugggggguauguuugaauccauuuagugguugagcaucuuaaaccugagaagaccuggcccgaaauacugcauugaacauugacuuugagcaucauguuugagcucaaaaaguuucagauuuuggagcauuucagauuucagauuuucugauuagggauaccuaguuuguagcagaugcacacauccgguuuuauuuuuaagugucuucuauucuuuggauacagauuaucuuuuuauaugcauugauuuuuuuggucugaauuuaaauguacaauccaugugaauucuuacgauaauuccauucagcgaugauaugcaaaugaaaaagggaaugguguaagugguuuuaugauuuagaaaucuugaacuuucuuagaaguuuuuuguaaaaauuauacagugguccuucuguauucugugggauugguucuagcaacaaccuccucaccacccgcagauaccaaaauacuggggugcuuaaggcauaauauuugcauauaaccuaugugcauccuccagaauagcuauuacaauguaaauguuuuguaaauaguugcuauacuguauuguuuuuguuuguauuuuuaaaauuguuguugguuuuuuuuaccccaaauauuuuuuaucugugguugguggaaucugcagauucagaacccaugaauacggagugcugacuguauauacuauugaaaaaaaucagauacuauagaagaguacgaagaagaaggcaaaaaugucccuagccagguuaccacccacagauaacuugucugauauauuuuagugaccaucuuuagcauguuuuuacacaccugcgugcauacgcauucccccauucccucucaggcauaaggaaacuauuuuacauaaauagcaauuuaguuucauugcuguucucuagcuuaucuuuuauuuuuacugaaucaguaguauaggugucucuuuucauguuuaauaaaaauauaucaacucauaauuuuuaauaguuauacauuaugauauguuccacaguccacaugaccaaaucccuacugguagauauuuuacuuauuucuuuuuuuaaaauacuauaauaaaaaagugcugugcuaaccuuaucuacuugugucauuuuucuucuuagcuuuaauuccuagaugugaguuugcuagaucaagggcaugcuuauucuuugcuuauucuucucccgucuccucccguuuuucuccuuccugccugccugccugccugccuuucuuuuucuuuuccccuucuccuucccuuuuuccuuucuccuuuuaccacucuggagugcgguggcaugaucacagcucacuguagccuugaucuucugggcucaagucauccuccuauuucagccuccagaguagcugggacuacaggugugugcuaucaugcauggcuaauuguuuuuaauuuuuaguagagaugggggucuugcuuuguugcccaggcuggucuugaacuccugagcucaagugauccuccacccuuggccuccuaaaguaguagaaugacaagugugagccacugcacggccuuauuuuucguuuugauaauauuaucaaacuguucucauaaaagguacaccaggagauuguuagagauguuuauaguauuauccauuucuggcaaacuuuguaaaggaugagcuaacaacugucuuuggaaauuuacaugucuauaaugucaagcuguuauguacagagaauugcuuuaugcugagaucauaaaaauuuuuguuuuccuccauucuaauguaaagcuuguuacuaauugaucuucauuugccggguuccaacauacacaugcuacuuuccucuuaagauugucaaguuauaaauaggagaacuuuuauuuagaagaaugcuaauaugaaucuuuuggaaauacuaguaauuagcuuucuucugcugucuccaccaauuuuaucugauuuagaaaauuauauuuccuuuauugagaugcuuaaaucggagggcuuaguuugcuucagaaaguuuauaaacuauauuauuagacuaauuuuacaauagucauuguauuuaggugucacuuuuaacuuuuuuuuuuaauuaaacuuugcagguuuuaaauaggucaguuucugacuaacccagaaguugaguauauuuugauaauacauuuuaaauuggccauauuuguaugugcuugaaauaaguggaaauaacaauucauuaaauaacaacaacaaaaaaaaccuuaugugaaccuggggauucuuguuaccaucugacuacuccuuuccaucucccucuguuccucuuuauccuguguugcuuguuaacacuggagacuaguaaaauuaggucugaauugggcugcucuuuagguccauggaucucaucuuuauuuuuuuugagacagggucuugcucugucauccaggcuggaggguacugguguagagauggcucacugcagccuucaccuccugggcucaagcaguucuccugaauagcugggaccacaggugcguaccaccacaccuggcuaauuuaaaaaaauuuuuuuuuuuuuguagagagagugucucuucuuguugcccaggcugaucucagacucuuggccuugagcaguccucccaccuuggccuaccaaaguuguaggauuacaggugugagcggccaugccuggcugggucucaucuuuuuaugucuuuuuagaucacuuuaacaaggcaaaaaaaauuccuccacccugucuuucuuucucauuauuaguacccucucuucugcuuuuccagauaauucacugcucauugcuguugccuagucacucccaguggcauggauagaaauaauuguauuggagaaauauuuauguaaaauagacugugacuuggugcuucaaagaugugggcauuaucaaaaggacaguuaguugaacugugcgugugacaugauuuaucuuuuuaggaaagagauuguaaggaaagcacaacaaaacuugaaaaaccgacuuuauaagaaaguagauugaauugcucacaaguuauuugaaaugguauuuguagaucgccucucuccuaguggguguuuaaucuaaccaaaaagaguuggcuaaacuuuauauauugauaaagucaaaaaauuccuuaauauuuucaaaacauuaccacuaaauuugucuucuggccaaggugaaagaacagagauuagacuuaccucucuucagaaacagcuaaaaaacugaacaaaaacauauguaacagcaguuuucaagacaugagauaucagacagugaaggacagugaucccugagagauggaaaacaaaugaggugaaccuugugauuaacccagcuuacuaccuugggagaguuucccaaccuuguauagaaagggggacaucagguggagccugcugaucugucugaauugaggagaccaaacuggaaguccacaguggcuaagguggcaauacuauacaagaaaacauacugaagaagagagagcucacauacagagagaacucuggcaauuuaccaagggaucccucuugaaucuuuagcugaugugaauucaggaugugaaugaagaggcuaccagagcuggaaaaagcaguugccaagaagaucacagucaacaauucucagaucuauacauggccaggaguaguuccuguucucacuggccaacguggaaaacuucguaacucgugaagcaccaaguaaggcuaauuggaagccauuucccucaguaguggggccaaauuagccuuagaauaaauucuucccugguuccuccugacaaaacuuaaaagcaagaccugguagaaugaaacuaauuuguaagcaguuuagcuacaacagagagcaaaggucaagaagauuuauaggaauaugaaaauauccagcacccagcagauaaaagucacauuauuuaccauguaauuaaaaguaccagacaggcaaaggaggaggaaaguaagacccauaaagaaaagaaaauguaaucauucaaaacugauccagaaauaguuacgugaaaacaucaacaauaauuauuauaacuguauuucauauguugaggaagcuuagaggaaagauuaaacauguuaguacaggagugaaacauauauacauagauaagaaauccaaaucagacuuugaaaguugaaagcuauagugucugaaaugaauaauauguuugaugggauuaauggcaauagacauugaagaacaguuuagugaacuugaaggcauagcaauagaaacugccccagaaaaccacacgcagagaaaaugugagccaugggauaacaucaggugaccuaauauccuuauaauuggaguuccugauggggcugaugggaugugcagaaaaaguauuuuaagaaauaaugggcaacauuuuccaaacuugaugaagcuguaaacccacagacucaagguguccagugaaccacaggcaaaauaaacaugaagaaaauuacaucaaggcacaucaaagaagcagccauaccaaaaaacaaaacaaaaccauuuuugaggaauaacaauaccauuggcuuuccguauccauggguucugcauucuuggauucaaccaaucauggaccgggggaagaaaaaaaacccaaacaccaaaaaaaucauacuacaauaaaaauaauacaaauaaagaaugccauauaacauuuauauuucauuagguauaaguaaucuagagaugauuuaagguauacaggaguaugcaccuauaugcauagacuacauacaacuacuaggcauuuaauaugagggacuuaauuaccuguggauuuugguaucugcagaggagcuggaggauacugaaaaaccaccguagugauagcugauuucucacuggaaauaauacaaauuguagacaguauaacaguaucuuuaaaauacaggaaggaaaaaaaagugucacccuagaauuccauacuuggaaaaaauauccugcaaaaaugcagucaaauugagugcauuuaugcacucagaaacugguaaaauucaaacgaggugggcaguuuagcuaaaauuauugcaccaguguuuacuguuuugaaacguacuaugguuauguaagauguuaccugccaucaaagaagguaaaagguaccauuucuugugagucucacauuaugucaaaagaaauguuuuugaaaaaacagcaaaaaaaaaaaaaaaaaagguugggggauacuucagacuauuuggugaacucucacaacuucguaauagaaaauuuaaaaaugcauuaaaaguagucaaaaaauguggacacuucaaagaagauauaaaauggcaaauaaguuauuugggaaaugcuaauuaaaaccacaaugagauaccacuacacaccuauuagaaugucuaaaaugaaaaagaccaaccaaaguauguauuccugaguacauagagcaacuugaucucuuauacagugcugguggauguaguaaaauaguacagcuaggcuggaguaucgcuugaguggcuguagugagcaaugaucucuccagugcacuccagccugggugacaaagcaauacccugucuccaaaagaaaaaaaaauaaaaaaucacaacuacuuuggaaaacaguuuacuaacuuaaaaagguuauauauacguacguauuauaugcccaaaucauucacugcuacguuuuuaaccaagaauaaugaaauguguauuuguuuacaaaugaaacguguauuuguguacaaagacuuguguacaaaucuucacagcagcuuuauuuguaauagccaaaacuuggaaacaaucuaaauaucuaauggaugaaaggauaaacaaauuauaguauauugauaaugucgaauacuaauaagcaauacaaaugaaguauugauaggugcagugaaguggaucaaucuucaugcugagugaaagaacccaaucaacuuuuuugcaacgaguuugccaccagaacacaggugucaugaaaacuaccccuaacagccaaaaugggaagagacuuuuaucaacauugucuucauuggacacauagauucaaggcaaguccaccacuacuggccaucugaucuacaaaugugguggaaucaacaaaagaaucauugaaaaauuggaaaaggaggcugcugagaugggaaagggcuccuucaaguauuccugggucuuggauaaacugaaagcugagcaugaauguggucucacuauugauaucucccuguagaaacuugagaccaacaaguacuacaugacuuagcauugaugccccaggacacagagacuucaucaaaaacaugauuacugggacaucucaggcugacugugcuguacugauuauugcugcugguguuggugaaauugaagcuaguagcuccaagaaugggcaggcuggcgaccaugcccuucuggcuuacacacugggugugaaacaacuaauuguugguguuaacaaaauggauuccacugagccaacuuacagccagaagagauaugaggaaaucauuaaggaagucagcacuuauauuaauaaaauuggcuacaauccugacacaguagcauuugugccauuugcugguuggaauugugacaacaugcuggagccaagugcuaacaugccuugguucaagggauggaaagucacccauaaagauggcagcaccaguggaaccacacugcuugaggcucuggacugcauccucccacuagcuuguccaacugacaaguccuugcaccagccucuccagggugucuacaaaauuggugguauugguacugugucuguggaccgaguggagacugguguucucaaacccguuaugguggucaccuuugcuccagucaacguuacaacugaagucuauugaaaugcaccauggagcuuugagugaagcucuucuuggagacauuaugggcuucaauguuaugaaugugucugucaaagauguucguugggggaguguugcuguugacagcaaaaaugacccacgaaugaaggcaguuggccucacugcucagugauuauucugaaccauucaggcuaaaucagugcugucuaugcccuuguacugaauugccacacagcccauguugcauccagguuugcugagcugaagguaaagauuuauugccauuuugguaauaagcuggaagauggcccuaaauucuugaagucuggugaugccgccauuguugauauaguuccuggcaagcccaugugugcugagagcuucucagaccauccucuucugaguuguuuugcuguuggugaugugagacagacaguugcugugggugucaucaaagcaguggacaagaaggcugcuggagcuggcaaggucaccagguuugcccagaaaucucagaaggcuaaaugaauauuaucccuaauaccugccacucuagucuuaaucagugguggaagaauggucucaggacuguuaguuucaguuggccauuuaaguuaauaguaaaagacugguuaaagauaacaaugcaucuuaaaaccuucagaaggaaaggagaauguuuugugaacuacuucauuuuuguuuuuuuucuuuuuucuuuugcaugugguaguuuuacuaguuuuuuaaaucaguacguuuuaauggaaacaacuugaccgaaauucugucgcagaauuuugagacccauuaaaacaaaguuuagugagaaaaaaaaaaaagccagguaaaaaauacauauauguguaugacccauuuaugugaaauuuuuaaaaaugcagacuaauucauagugacagaaagucucagugguuuccuggagacuugggggcagagagcagagagggguggaaaggagagagggguuuauaagaggccugugcagacuuuaguaugauguuuauggucauuauauugauuuggguaaugguuuccagguuguauaucugugucaagaguuaccaaaguuuuaaguaugugcaguguauuacauguuaauuguaucuuaaauaaaguuguuaacaaaaagucaccagguuagguuuucauucagaggauggaaagauuacugauaccaauuuacagagcccuuaagauagcuaaagcaggccgagcucuuuaaagagcuguccaauaguuuuaugaguuuacuaugugauuaaaauaacccugaccaguauucaggaauauuaguuucucauucaucccaucauuguaugauaacaauuuuuuucuuauaggccuuuuugggccauauaugcaaugaaauguuacauaucuuacguuccguuaucauucaacagaaacuucuugucuuuccaucuaauuaaaaaaaaaaaauuaggccaggugugguggcucacgccuguaaucccagcacuuugggaggccaaggugggcagaucucuugaggucaggaguucgagaccagcccagccaacauggugaaaccccaucuccacuaaaaacaaaaauuagccgggugcgguggcgggcgccuguaaucccagcuacucuggaggcugaggcaggagaaucacuugaacccggggggcagaaguugcagugagccgagaucacgccacuguacuccagccugggugacagaguaaaacucugucucaaaaaaaaaaaaaaugauaauaauuacaacaacauuuaagcuaacggucaggauucuugauuuauuauauuugggucuagaagguagcaguagggaucauuuuugaaaguugggggaugaugucauuuuggagaacucacuauauaagaagcacuugguuguuuuggacaugaaaauuggggggcaggcugggcacaguggcucacgccuguaaucucagcacuuugggaggcugaggugggcagaucacuugaggccaggaguuugagaccaacuuggccaacaugaugaaacauugccucuaccaaaaauauaaaaauuagccaggcuuggugacacacaccuguaaucccugcuacuagggugacugaggcaggacaaucacuugaaccugcgaggcggaaguugcagugagugaagguugugccacugcacuccagccuggcaacagagugagauucugucucaaaaaacaaaaaaaaaacaaaaaaaaaauugugggguaaauuugaguguaugagaaucuuagacuauugaaugaacauuaauuuuuuuaaaauguccacuuagaacuauuuaaaauauaaacguaaauuaggguuuuaauuaugaauauaaaugagugcauaucuguauauuuuacagaaaccaaaaauuuaauauuauagagaaauaucugucuuuaggaaaggauuauucaaacauaggucagggauaguaaaacuuuaguuuuuuuuauuucuauuuuucuuauuuaucccaaacuccuuauuguuguugaaguuauaauuuauauaacucaaguucuuaugucaucuaauccuagauaaaaccuuugccuccuacaccugaaagaaauagguucuuuucucaacagguauuucauuuuaaugugauacuuguucuaguuaccaguuuagccuuaucuuucaaaaaauuauucuuaacauguuaaaaauauauaccuaugcuauuuuuaauagauuuuauaguuuuaaaaaaagauuuauauuuuaaaccaguagaaguuuuaagaaugcaucuuuauuguuacauguuauuuuaaagauuuuuaucaugaaaaaguauucuagguaaggucuuaauuucugauuuuuaauuuaaauguaucugaucauuuucugaucuggcuacaauuaauuuauauuaucuauuaaagaucuuuuuugugugcuguuguaccugaaucuuacauaauuauuuuuucugccauuuaaauuauuuuaucuuuaaucucaagugcucacaguugaacaaaacaaacucucaaaucaccaaaucaaggaauacuaaaucaagaaaggaaggagaguuuuaggucaucauuuucaguucuuaauucagauucauuguugaguagguuuuggcauccgugguuauugaaucuguagaaguuacaguguuguauguaacucuuaauaguuagguuaauuuuaauaacuuccacucguacauauuuggagguccuuuauaauuuguuaugaaagguagaauggaccuuccccucuuuuuuccccuuuacagggucucaaaaauaauaaaaauacucuuucaaaauaauaagguuagagaaacucauuuuugaaauuagucuguuauuuacuguaauuauaggauauaugugaaauagaaacuggguaauaccuguuucucaggaacacacuaaaaguauucauauuguguauuauuuuccuuauguaauuuugcugucuccugguaaucuugcguaauccugaaguccacgucucuaggcauuuuggacuauuuuaucaagauaucaauggcuuuuaucuugacccucaacuucuaagauuuagguuuaacugggacauaccggcccugacauacuuuucauucuguugguagccauuuguucccuuauaacuaggaagguacuacguuaguaaaaugcaguggcugguuuucuucuccagaaaucaaggaauuggccaucuguuuagagaacaugccacuguuuucgggaauguuauaguuggaaauuuuuuaaaaacacauuuaagucacaaaagaggauuuuuuuccccuuuggaaaauauagccucagaccugauuauacuuuuucagaaauucaugccuuagauguggcaguaaaagauugauucuguaguucuaguguauuuuaauuaagcccagauuuagcauuuguucuauauuuuaucacuuuuuauuuaacuuuagcuggcacauaacugauaauacucguuuuggaguuuacauuuggguuagccuggugacuuguuaccuuccagaucuaguauuuugaacucuuaacucauucaaauuaaauagggaaguuguucuuucugccuccuguggaaauuuaaugugggcaauauuauauagacuuuuuaugaaucuuauguauagucucauauguucuaguauuucuuaaagcuaaaaauagcaugccacuugaauauauaaagaguuguagcauaguaccacugugaaaaagguguuuuccguguaaucucauagccaaauauuuuucaguguaacaagucacgcaugguacugcaugggcauuaggaucgcuuuaguuuuucuuauaucuugauuccucccauauuugccguguuuuuaaauguuucucuaaccuuuacuuuguuacuuaaauacaugauaccauauuauuagggaaauguuugaaguaccuacaaaaaagaaagugauuaauuuuggaagaaaggcaguuuugaccuuuaucuugguagaagugguuuaaagauacuaaacuugaaauuuguugcucaguuuugagguaaucucaaccucccaguucucuaaaacuuaguaguuugguaaugaugcaugcuugauaauaaagacaaauuuuacacauuacugagguuaaaauucugcaaaugaaaugauuaaagucuucaaauuugaugaucagauuuccuuuaagaaauauaauuaugacacaccaaaauauggaaccgaaaacacuuguuaauccuuucaauaauauauuuuacuuaguaaauaaagcacuguggaauaugccuaguagauucaaugucuuuuuucggcuuaaaguguguuaacuuacuauauuugauuuuuaaauagacaccaaauccuacugcaagcgaguuuauuccuaaaggaggaucaaccuccaggcugaguaacgugucccagucaaauaugucugccuucucucaaguuuucucucacccauccaugggaagcccugcuacugcuggauuagcgccagguaaguugaguaacuauuuccagugaguuccagauaccaugucuguaagcaccauuuacuauuaauuuaucagaacugaaauuguauacuugaaugauucacauuugaacauuaagagcuuuauguucuaguuuuugguaccauaggccaaauguguaguugagaauuuuaaagcaaaauuuaaauaugaaugaaauuacauauaagaauuuuuauauauaaaacucacaaaaaaauuuaaaggggaaaugguuauuuaggaaaaaaucuaucuuuuuguauuucucuauuuuuaaaacuuugugcuguuucacucaaacuuacaaaggcaucagaaagaacgugaauauuuauguacauaugccucagaguccuccuuuuacauuaaauuucuaaaaaauaauuuaaucauucuacaucuuuagaugguauucccuuucagauauuugauuauaaaugcuauaguaguaauuuuaaauuggguaaaguauuauaaacaguaguaggaaaaaaauauacuacaugagggaucauugcaguagagaaaaacacuuuuuaguuaucuucugcccauaauguacccauaaaguguacccauaaugacagaacaauuugggcaaaugugcuuguacuccaggaguccugaaggcauaguucaaugugacccuuugagaaaucuaugauucuuugcagucuucauuuuuaucuuaagaauucaugcagauuuugcaucugcuacuccauaauguuuauuuuaguauaaaaauauuuaaauuuuuaaaauuaacaucacuuauccccacugcuguauaccuugauuuggaaaguaaggugguaugcacaaucacauugaauucauaguaagugcugagcagauugguaucuuauguuugucgaauguuugaguugcacacacaaauuaggcuucuagaaccuauacaggaaaaucaucacuuggucuuggacauuaaaaaaaaaaacagaaauaaaaugaaauauauacacacacuaaaacaaagccaaaggauauaucuagaucagccaggaacugguacugucuccagggcuuaaucuaauuaguaaguaaaucguugauuuaaauacucauauaucuaauucaaggaccucuuugggaagaaaaaugggagaagauaaagauaacacaguggcgcagagcaucuguuuuagcauuaaaguaucagaguacucagagcuuaauaaccuuguguugcuaaggauuuugucagcgccucauuuccccaccauucuuucucuuacuaccugucucccuuccaacuccccucccaccacuuguucccuuaccuuuucuucuacuuugguuuuuuuccagguucaguuaaauuuguaagcauuuuccuuucuucccuagagagcagugucagaauugaauaucucugguagccuuaaaguuuuauuguaaguaauauacuacuaugauuuuucucuuguugagguguguucacauuguuuacaugagcauaaucugcaaaugagcuacacaucuuaaaauuucuuaggcauugucuagacuucugagcaguguuguaauucaacuuuauaugucucuuuccaaagcauccgcaauaaugggauccauauagcaaucagaaaacuuuggccuuaauuacaugccaguuuauuuugcccuaacaauacuuccuuccucguaucagaaauaaacauuuuguuaacuuauuucaugaaacuaauuuagacaugccauucaaaaaaaauuagccuuuucaauuggaggaguuaaaaauauuaaagggaauuuuaaauuuaaaaacauucaguuuaagaaaauccauuaaugcuuaugguauagguauaagcuuauuuggagguagguauauucauuggucccaauuggaccucacaauagaaacuuagggugaaauuaauuaauuuaaaaauuaaauuagcugaaaaucuauucuucuacauagcccuagcauuaaaugguuauucuagcuccucuuaacaaugaaagugaucacucucuggaaccauuggaaauaggucauuauaucauaugaaauguauucuugaauucuaaugacuauuauuuuaaaagugcucuucauucagaugacaacucaguuaaaauauuuuucaacaaugaugaauuauuuugcauuaauuauuuuuucuguuugguuauugguuuaacacucuggagaugagcaaagaaaaaauauuuaagucugccuuucggaaaaaccauuguacucucagugucuuccaucauuucuuaccuacaaauguuguuuuguuuaaggaaggguucuugacauuugccguguaagguuauagaauaaauaaagaguuuauuuaccuacgguaguggugauuuaguuuauuuuuaauucuuacugucuauuauagguguaacucauugauuuuaguuacaaguuuuuaauuuaaaguuucuauccccaaaacuauugcccucgaaaguaucaaauuacuauaaaauaugaaaccuuaaauacuuugacacuuauguaaacuaggguaacaucauuuucauuacguaugggaaaguacauaucuaaauauauuuuugaccaaauauauuugucaaaauuuuuaggccaguuuauuuugucccaauauuugagcaaaguugaguggauauuaagaguggguuuccucaaauuaugaggaacaaaggcauaaugccuggcacaaaggagacccugagugaaucacauugcuuuuuaaaaauuuguuuugaucacuuaagaaaaaauaagucauguuuuugguauaugucucaauguaagaaauaaaacuuuauacaaauauuugaauuuacucacagcuaauuagguuuuuaaaaagcguuaaaauuugugacauguauuucuaucaaauuguauacacacucauuuuuuaauuuaaggaaucaaggauuuauagauacaguuuuguuaugcauauugaaccuaugaacaauagcuacauuucuaaguaucuuuugugaaguuaguuguuuuaaugauacuaaagauauggcacuugggcuugucuuuaagaaucccuccaguuaugcauauuuuuauuuauaaauagacauuuuucucuggcaacagcuuuuauuauucucucagagguucacagccuuccaaaauuuaagaaccacuguuuuuuuuuuuguuuuuuguuuuuuguuuuugagacggaguuuugcucuuguugcccaggcuggagugcaguggcgcgaucucugcucacugcaaccuccaccuccuggagaaccacugauuuaacacaacuuaagacuaauuuccagaguguuauacaguaagaauacuuuuaaguaacacauagccuaaagauacauuuuucuaguagcucuggcuuaggcagaggguuuuuuugacuagaucucuggaaacgaaguuaugaaugugcuuaauauaugaaauaauaguuuauacuuuaauuuuugugccaugaaaagugauuuuuuuuuuuuuuuuuuuuuuuuuuugagacagagucucucucugucucccaggcuggagugcguggcucauuccaagcucggccugccagguucacgccauucuccugccucagccucgcgaguagcugggacuacaggcgcccgccaccgcgcccggcuaauuuuuuuuuguauuuuuaguagagacaggguuucaccauguuagccaggauggucucgaucuccugacuucguggucugcccgccucggccucccaaagugcugggauuacaggcgugagcaaccgcgcccggccaaaaaguaauuuuaucgugagaacuaauugcugaauguccuuuuucaucagaauuuucccgaguauuuuuaauaguagacauaguuaacuaagucuucguguacuuuagguuuaauuaccucaguguuaacaaauuuacagugucacaguguguuugaaagugacuguaagugcagcaggagcagcacacauuucugcaugguguucuuguguaucauuuggugguuuagugcacaguugugucucaggaauugagcaucucuccuucugcuuaauuaucaugugugggcccuuaggaggggcagagaugaguucuuauauuugcaaaugucaucauuaauuuauaaaugagaaaaugagucacagugauuuucagcauuugucaauauucauuccuucaagaugaaaauagugcaguuuuuuuuuaaucauuagauauguuuucuuguaaauuauuauuacuuuagagagagugucucacucugucguccauccuggaaugcaguggcaugaccguagcucacugcagccuccaguuccagcuccggcgcaagcaauucucccaccucaaacuccugaguagcugggacuacagauacaugccaaguuaaaaaauucuuuuuaaauuuuuuuuguagagacgaguucucacuauauuuuccaggcuggucucaaacuagccucaagugauccuuucuccucagucuuucaaagugcuagaauuauaggggugagccaccucacucagccuuuguugcauauuauuaaggcaaacucauaugauugauauggggagaaucaucuaauuauuauaccaaaauuagcauuauuaaauaauuguauucauuuauuaccaaguuuauuuauuguaggcuuuugggaaaauaaauccaaagaaaauuauguucuuacauccaguuuuuuaaaaauacggaaaagucauuucuuauauauuccugagguuauggugccaaauugguggguaaaauuggcuaauacccuuuuuuuaaauaaacauuuuuagcuugagaaauaugugagggaaaaagggaagggaaagaaaaaggggaaauuaauauuugucguucuuguucagaaauaucaaaacuuuuuaugaacguuguagacuaaaaauaguuauuuacucuuauaauguugaaggguugggauaagcagaucguuuucaguuuaaaguucugugccaaaaaacaaaauuccgugauugauuaucucuauggcauuucauaucauagaugagcaaauggagguauuagguauuuaaauuacauaguaguuggauuaggcaauaacaugauauugguuauugauuuaaguggaaccuuugggauuuacauaguccagccuugcgccaaucuagagguggcauuucugacagauugucaucuagucucugcuuagucauuuacaguaauauaaggaauucauuaacuaaccaaggcagccagcccaguguacauuuuaacaauuugaauacaaaagaaaacucagucuucugcuaaaccaaagucuugucucucuuccauccacuuguccuaguccucuccuuuuuugcugaaugggaaaaaaaaacuuuccuauaugauaguucuuuuaguuauuuuauucuucagacuaguucuguguguguccauauaacugauuuauuuguaagacagacaagguggcgucaggcaaccggggagaaguauuauucaguucaacgaauuguauagguccaaaauugugaacucuuguaagucauaaggaauagaacacuaguguggguaaaauuaaauccacagauaugucuaccuagcuauauuacuacuuugguauccagcuaaggaguguaccauugggaaaacaggaaacucuuuggaaacuguucuuuuuuuggggaaacaggaugaaucuauggucuugaagauggugaauaucuaagcucagacuuuaaauuucauugugcguuuuagggcucuacguuaagucuuucaaggcacaaaaacuccauaagcgauugcuuuagauuauuuuguguuuacuaagugauauaauuauuaaaaauaaaaauuguaaccauauuuauaugguucuuaaauaucaccaguuuuaauaaacauaacagauuuuccuuguaauuguuucucagaagucuacuguuaaauggauucugugggauagucaaauaauuacagcucaaauuaauuugauuucugucuaaauugaauucuucaaauuaguuuuguacuuaauaucaauaaugguaguuuggcauuaaaguauccuucuaauuaauuaauuagauuuccuaaacaucucacaaauugcuuaagaagaagggaccaugccauuucucaucuaguacaaauuuagguauaaaugguguuuaauaaaugcuuacucaauagauaaggcuuaauuuuugucuuggaaaauaauuuuguaauuguuagguaucucuuaaguacagugaauuuuaauuaauaaacaucuuugaagaacuucuaaaaacugcaaauguucaagaauaugcaggugaauagucaaaugaggaacagaaaugugccuggugaaaaaguuuaacagcaucaaaacuagacacuguguuuugagaugcugaagcacucuuauaaccaauuaaaguauuuguauuuuuaaauugcauguuuccauucuuuguaacuacuuuguuuuucagguauauucagcagauucauucaaaucuuuccaaguuauuuaguuuggagauugcuuucuucauuaaaaaacaaguaaauuaacaacuauuuuaugauuaagaugagggaucucaagguuuuugugaaguggaccuuuuaauugcccuguaaugaggagcucauccuagaaggaagcuccucuguguaugcauguguaaggacacagauugugaugccccugggaaauuuacuaacaguagaacuguagaaucauaacaggguugggagugccugcuggcuauauucccuucucaguugggaauuucaggaaacugaggcgagacguuuauggcgcagagagggauguggcugcugcagcuggcuuggagaccugucagguaaggcuuaaauagcuaccaguagauaauauucuacugguuguggaaucccugguuaauggguccucauagguauaagaguuccucuugugaacuuccuguuuaaaucucauugaauuggcuauuuugucccauaauuaggggguaggggcuggaugggaguggguagggauuuccuuuaacuacgaguuaccgauccagugaucuacagcugcagcaaagucucuugcugcucuuggacugcuuucaguguauuaugacucgauugccuuuagaacaugguaccaguucuacugaagcagcuaugugauuuucagcauaccgcuugguuucuguguuuuagagucuucaguucuauaagaagguaauaguagaugauuuuaagucuuucuaaucuaaaauucuguguuuuugagacauggaaaucuguagaagcauagaggacaguaaagagacagaaaugaagacaguggugcgaaguaguaaaaagggaaggauaacauuuguacuagacuuaagaaagauuuuagaaggcauauggacuucuugacuuauucuguguaaauagaaaaucuucccauggcucccuuuguuucauagguggagaugaggggaguuuuguuucagcaaauguaagauuagagucuggggugaaucagaguauuguauuuguucuggaugaacugagaagcagagagaacagguguaaaugaaugcccgagaauguuuccgaucuguuucauagcugaacguggagaguuagaugucgaucuuccuuccaccuucuucuuuagucaaguagguugagagcaccagggaucauuuuuucuucaaccuuuuagcucagugauacccagagcaaugugccuacucaguggagaagauaguauuugugugaauaaauuuacuguucuguguguuacaugucuaguuaggagugguccucuaauucuguaggaaugaaucagaugguuguagccccuucuguuucuugaauuauccuuugauucuucucagcuugaccaugaaauucaucuuuuucuuauucuuacugccuuucagauguaguuacucuagaguagggcauguagguagggucuuaguaaaaggagaggaauuauagauguggccuuuuucaaacccccaaugcauauaggcauguaaauccuacucauaaaugccugcaacaaccuagauguggauugcauauuuauuaugguaauaauguuuaguucuaaauuuuucagucacgaaucucuuacauauugauaugucugaaauaagauguuuucuuaggauuucauaagcacuuuucuauauuuuacaugugguugucuagauuuuagcaugguaucccuauacauaguaacuaauaacuaguagucauuugguggggguaccuuugagaaaacaguaaaauuaacaguaaacaauaacauuaagauuaaauauauuaacauccuauugauguuaauuaguauugguguaaagggugucaguguauucaucagcugcucucuccgccauaguuaauaugcugcucucucagccauaguuaauauaggucauaaucuuauugcucacugugugcgaggugguguaaguuaaacugcccaaacaaauagauccaaaauguaaugacauggcuuaauaugacaaaaauguauuucuugcuuuuguaacacuccaaggcagguguucagguuggcuaggaugcucuucacauagcuuauaagggacacaggggaagagcuucucagcaucucucaagugagcuagaaaggaaggggaagagcaugaaggagcaagaaugggaagaugggaugacccaagccuggaaguuucuccuaugaugacuuuugacuaaaaucuggacuuaaacuauuuuaagcagcuuggcuacauuucccagccuccuuuagaagcaaaaguuuuuaacaguugauccugguuaucucaugaauauacauuugagauauuuucucauuugcaucuuuuguaaugacuuuaaaaauaucaccaaagcagcugcaauaacugauuuaucuagcgucaggggaaaugaaucuuuccagcauacuugaauuuuuuggguaucagaagcuuacaguuuuaauugucagaacuuuauauuuuccaaaauuuuuccauaguacucucuggcuuaaaacaaaauauaaucuuauuuauugaugacucuuguucaacuauaugugccucaguaauuguauugaaccagaauacacugacucuuuacauauccaaguuuguagaggaguuuauuucaaguuaugugauuacuuagauuuguuauucuuuccacuggucuucugcuccaaugaauuaguuauaacuuuuugaagguaaggucuuucucuugcuucugagucucuuaaagugccugaaaguagugccuugaauggccauaaucuggcaagcuuacuuugaucauuuuuuuuguuuuuauuggcuuuuuuauugguaauucuguugugcuguuugugacagugauucucaaauuucagucuaccagaaucaccuagaggcuuguuaaacuccagcauuugcgugguuccauccccagaguuucugauuuaguagcucugggugaaccagggaagauuugcuuuucugauguguucccagguguugcugaugcugcugcuuguccugggacuucauuuugagaaugacugcucgauuuagaacuuuugucauucuuaucuccucuuuccucuuaaucucccuuucucauccuccuccuaaucugcugagagcuaagaacacaaagauaucuuuuaguaccucuuuuuuuuuuucuuuuuuuuuaaaugagaaaaaggcuuugagucaaggacuugaauuguuuccugugaauaagguacaugagcuuuauauuauccuuuggcugaggcuaguaucacuucauuucugguuaaugucuguguucugaauaacuagaguuauuguugaauucaugaauauaggaguugccgaugcuuagucaugaauaaaucugggaaacggauuccuuccaccuugguaauguuagugagacaaaauauaaauuaguuacuauaacuuuuaguuuuucaaaauacuuaggaaaugaguagcauaaguacuguggcuguuuaaaauauaaaacccucaagcagaguuccauggauggaaaaaaaaaacaacccuaugguucuggaacuaguaaucagauaucuuuuauuuacauguuacacuuuaauauguauguuuuuaaauuguuacaaaaaaaucaacuaaauuguucacaugagaacauguccuggcaaaaaaagaaagagaaaauaagagaaaacaacuaaauuguuguuaauguuagauaaauaagaggcacuuauugauucaaccacaguuuucuggagaucaacuuuaauuuuuguuuguacuuuggugguagcuuuuuucauuggaaagaaauccaaaauuaaaauuacauuguuaacuaaaucuuacuuuuuugugugaauuuuuguaauuaauuuucauaagacacucuugucuuuaaguuucuuguuuguaaacaacacaacacaauuuaucacuaugaaugaaggacaccauuuacucaaacagucacuaccacucaagaagaaaaaaaugguucuuuucaaccaaaacaguuauauuuaguagcuaacaccuuucuucccucuguuuugaugcuucguuuaaguaaguguuauuauuuaaaagauugccaccauuguagagucuagggagaucccaucauuuuagaucauuuggccaaguuuggggacaagcagguagguuacuguuuuguuucuucaaacauagagaccgaaguaaguaaccuacuauuauaggccaguggguaagauuccuacuaguauaguuaaaacccugaugcugguuuuuuaaaauauguugaauuauucauguuuuugggauuuaggcacugcacuuuauacaaucaauagucuaaugauauuuguuaaauuaauuaaugacaguucaucuagaaaugacaccauuaauacaggcaagacugaaguuaugucaaagggaagauuacuauguguagaccaggaaaacaaaguaguugugcaggcugugaucucuaucaaauauugaggacuguguguuugauaaagcucagguuaaauucaucauauaaauugacauuaugugccugaguuuggucaauaagauuaaauacauuuuaugagaaagcuuuaagguacuuaauuauuuuguuaaugcuuacaguauuucuaauaccagauagucuuaaguaucuaucauagauagauauucagccaaaaugaaguaggauuauauaaauuaguugaugaaauucuguaguuauuaaggggaaaaucagagauggaaauuaaguugcaauuauuuggguuagauccacauggccucuauuaaaggugauuuacauguaaaaauaagucuaggcaacacagcaugaccuggucucaaaacaaauaaacaacaaccauaggcagguaugguggcacacaccuguagucccagcuacuugggagcuugaggcgggaggauugauugagcucaggaguucaaggcuggagugagcuaugaucacacaauugaucuccagccugggcagcacagugagacccugucucugaaaaugaaaauaaauaaauaaauaaaucuuuuuagaguacuuugaaauuugucguuuuauugcauaauauaaagagauuuuguacuuuuaaucaguucaugguguuauaauugaaaugucacuguuacgcagucauaagguaaacauuuagcacuuuuccuuuauauuuacccaaaagugaaaaccaguucuuguuuacuucucaaaaaaaugaaaaagaauacuuuauuuguaauaucuuuguagucucauucacagaauuccuaaucccccgcaacccggaggcuguaaaaaugaggauaagggguuagaaauuuccaagaagugacuguuguuaagauagacauugaaggacagcaaaauaagaguagaauuagguaucauaaagagcauagucuuugaauccaagguucaguuuaccccgaaucuagauguuggauacuucaagaguagaaaauuguucuaucacauccuaaaaaacuguuguuuuaaugguaacuauugauuugacccacuuuaaaugggauauauuauauuugcauauagaagaugaagcucuaguagcuucaacguaaaaaaaaaaaaucuuugaaauguaugcucacuuuggcagcacauacgcuaaaauuagaacaguacagagaaaacuagcauggucccugugcaaagaugacauccaaauucaugaaguguucugcauuauaauauauuuuuaaaaaauuuauaaagauuaaaaaauaaaaaauuuauaaaauacuguauugagaauuuaauuuccauuggcauaaacacaaaugauaugcacagaauuacauauacauguauuaggaaucacauuaaguguuuagauaagggaucuguuaauuugaguucgagggugagcaacccuuauccaaaaacuuuuuuuuaaagacucccuuuuauuauguuaggcuaaaauuguaaccuguugacagaaaauaacauaacugugaucuauggggaaaucaggccucuaugaaaauaaugauuugugaguguacauauuccucaucaauuuuacagaacaaguuuuuagguuagauucauuauaaaacaucugaauuuacagauuagaauacuauuaucuuuuuuuuucuugaguagcuuaauagauauccagcaugcagauuguuaaacuagaauacgaaaauuuuaaaucaguaauucugaaaggcaaauguauugguauaguuaggaaaaucauggguaguaacuucagaugguugcuuuuaguaauucuuuaaaaaguggaaaaaaauuauguuaaaaaccucauauagaggagaagggauuuuugugauuugcuuaggugcauuuuuuccuaauauuuggaaauuaugacacuuuuuuuuuuuuuuuucaggcggagucucacucuauugcccaggcuggagugcaguggcaugaucucggcucacugcaaccuuggccuccugggcucaagcgauucuccugccucagccuccugaguagccgggauuacaggcguguaccaccacacccggcuaacuuuuguauuuuuaguagagaugggguuucaccauguuggccaggcuggucucagacuccugaccccaagugaucugcccaccucggccucccaaaguguugggauuacaggcaugagccaccaugaccggccuggaaauuaagacauucuuauuagaauuguggcuuauuuuguuuggaggaaaaguauauuguguagcugugugcauuuuuuuauguugcaaauuaauuuuguguuugaacauuuauuccuugaggaagcuuuagagguaccucaggaugucauaaaaucaguguagaaauuaaaaaggcuuuuauaauuucacuggcaaauaucagguuuauagucuuucuaaaaucuaaucucccugauguuuucccuuuguauuucuguaaaaagaauauaguuccauuuauuucaucagaaauucuguuuuauugcauuaacauugauuucauguuaaucuuuuaaaaauuaaccaaagauguguaucagcauuucccaaggugcuuuuaaaauauacauugcuggccaggaccccuaaaccuaccaauccaguuucucauccagaccuccauuuuucuuuucuuucaguucuauaaaugucuuuuuuuagaaagccuuucagguauugugaugucaauccuauuuaagaaccagugccuuaagagaguugaggcaguuaagaagcacuaguguggucugguacagucagggagaacaggcuucccccuuccucuuacuuucaguuccauguggguuuuguuguuguuauuuuaagaggcagggucuugcucucuuuuccagguuggaaugcaguggagugaucauaauucauugcggccuugaauuccugggaucaggcaguccucccaccuuggcccccaaagugcugagauuacuggccuccauauguuaauaauuagaagaaaacuuuaauauauuguuuauuaugaaaaauuaaaauuuuucauguuuuggaguuuuguaugauuaugaagauacuauuggugugcaugugaauguauaauuucuauaugcuguaaaaauuauagguaacaaggguuuuaaacugauuaauucauuuucccaucuucaguuuucucuguagcuacuaccuaagcuaugugaaaaucucuuaauugccuuaggaaaguauguccuaacuugucuucauaccucaauucauuuuagaauuuauuaacucuuauccuacauucuguuugcugaguuaaggcuuuuucuucucuaggcuuuuaugaaguugaguaaacugaucaucuuccucuugaguauucuuuauuuuucuuucuuuuuuguuuuuaauuucaaaaccuucauuuuaagaaagauucuugaacaggaaaccuaagguuuauuuuugugaucuucauuuuccauaucuacuuggcuuucauauuauaucuaugaacugucuucuauuuuccuuuuuuuacucuugccaucauagccgcuuccaugcacuauuuaggcuaauuggucuacccuugcauuucuuuuuuguauaauaacaaaaguaaucuuaaauauagaccaaaucaugacuaaauugucauuagaauaauuuccaagccccuuaccauggccugcauaaucuguuuuauauaccuauaaucucaccugucauucuuucccuuguguacuccguucuggccuuuuacugacauuccccaaauaauguaaagcuccuuuugauucauguucucugcaugugucauuccucccauuccuuccauggcugguuccuucucuucuucuuaggucccugcuaaagugucacuuauaaaaaaaggccuuugacaauguaaaggaaguuucccaccauuauuuuccauccucuuccccuguuuacuuccuuuaaauaauugaagguucuauuaaaauacugccaucuuucuuuucugauuaaauggaccuagucccuuugacucuacuucauauaggaccucacucuuuuaugaaguacaucuccuguucuuuaagaauauguauuugaacauggucagccuuuuccccaucaucucugugccuuugcuugggccuuauguugccuggaaggcucuccuauuuauugagaucuuugccugcuuuuuauugauuaggucaaaugucauuuucuuggaagucauagcuacuucucuggucauuauaguaucucccauuucuuugcuuuuauaguguguugaguaucucauaauuuuuuaguauuuuugucuuucucuaauauacacacacacacauacacacacacacacacacacacacacauauauauauauauguauuuauuuuagagauaggcuguagcccaggcuggagagcaguggcucgauuguagcucacugcacccucaaacuccugggcuccugucucacccuguggaguagcuaggacuagaggcacucaccaccaugcccagcugauuuuuaaauuuuuuuuuuuuuuuuuauggaguugugguugcuacaggcuggugaaaguugcuccaggcuggucaaacuucuggccucaaaugauccuccugcuuccaccucccagaguauugggauuacauacgugaaccccgugcauggccuucauguuaguuuuauacguauuuauuuccuccacuaaaguuaaaugcuccugugguauuuuauccuuuauugugcucacauaugaagagcuacaguuaaguauuaagauugaacauuuuuaagcauuuuaaugagcuuuaugguagaaugugaacugugugaguuuagaccuagguuuuauuucucgauaucuucaauuuuuagaaucuugcucagcguuugaucucaugcugguuccagugagcuuucauauauagguacagaucagaaucacauacggugcuuugaaaauauaaauucucuaguccccaucuaggaccuauuaaaucaaaaacacagauuuggagcaucagccuuuaucuauauuuuuaaaaaauucacaggagauucuaacauauaccccuuuacaucuagaguaaaaaauguucaaaaugccagaaaauuugaaggaagguaaauuuuaucugauuugaaugaggauguaaaggaaaaaacuuucauggaagaagaacugagaugguuuuuaaaggaaggauaagauuuuuuuaucuguuuuaaaaaugggcaguugagagucagugaaguuuguuauuuuuucuauuuguuuuaaccaguuuagcauaaagacaauguucucagugaauguuuaaaaauuaauucagucugaauuaggugaagacugaaugaacaucugugaagaaaaucucaggcaugguuccaagccauaggcuuagagcaggguucuuuuuauuuuuguagagauggggucucccuuuguugcccagccuggucuugaacuccuggacucaagcgauccuccugccuuggcuucccaaagcguuuuguuuuguuuuguuuguuuuucuuaaaagcaaacaguaccuugguaucagugcauauugguuaaauaucagcucucuaaaagugaugauuuugcaugacuauuuagaauauugaaaucauauggauucuuuuguuuuacagagcucugucuuaggcucuuagucccugcuuuuguuauguggaguuucuuuuuaucuuuucaaauauuuauauccaaagaguagaauuuuguuuuaaaauuagcauuguuaggccagugaaaacauuagauugggcuggaacauggaaaaauuaauggaaaauggccuagagguagacagauuuuuuuuuuuuacauguuaaguaccugaugcuccucuuuuaaaaucuuuuuaacaguuuuauuugccaucagcuucacagaguuuggcacauuguuucuugaggguugucagaauguggggagaagagacuaguagguaauaagacuggaaaagauggguuggaaccuaacuauaucacuggaacucagaaaugaacaggcaaccaaaccuuaagacuuaauuaucauuucugccccuagagaaccugugaaccagaagcaccaaaacuuaauuagagcuuagaacauuaguuuucauacauuuuuaaaaaauagcagcaguacucuugugaaguccugugugaacccccaaaccuaaaguuacauaaagcagauaaagcuggaauuuaccgguucggguuuauuacauuaacucauaaaguuauucagugagaauaacaaggcuauguaguauuuuauugaauauaauagcuugaaauuggugggugaagaauaauaauuaacuuuguaucccucaagucuccuuuuuuauauuuuuaaucauauaguaacaugaaaaucaugaauuccauggguaaguuguguacucauguguucaaguuucucugaguacaugugcauuuaaacaaagauuauugcagagucacuaccuuccuaauaaaaaacaucuguauguaugcacaauggugacaagagagaggcuuuaccuugaggucugcaugaaaauauccuaacccaacacaaaauuaaguauauugguguugguauguuaaaacaugaaugcauguuaauuugaccugcauuuguguguuuuuauuuauuuaauaaacaguggaaaaacagauaaaaagaaauucaaaucaggcauuuacaaaaccccgaggcacugcuggaagccuaagguguaguuaaaacuguuuuaaaaccacugccauagguggccuguuucucaguaggagggaauuuaccaguacauagguuaaggaggcuggaaggcugcagcacuuuucuuagcugagauuccucauuugaaccaaagaguacagaaaagugauauaagcgauuauuuugucauucugcaaaggguaaugucuaucagguggcauuauacaauggguguuuagcucauuggugcuuaaucccccugaaaccccuuuugaaagguugggaaagugaggaaucaauaaggcauuaaaaaccaaggaaccaaacaaaaaagacacuuaaccaaaaugucagaugccuauauucaaaugaguacaauuuucaagacaaugcauggucacuacuauauuguauuucacaagucugagcucuuaggcacugaguuuauggcugagaaucaagauuuguucauguuaaaacuuggaaaugagaaagauauauuuuaauuaggauagauuuucauuugauuaauuaauagcauugauacuuuuuuuaaugaaaaguuguauuggccaccuucaugauucugucuggaugcaggcuugaguaacguuuguaaacaaaaaaacuuucagucuaauucauacaaaaggaaaaaugauguuucaguguuaugaaauuagcuugagcucuuuaguuccuuuucuuauuuuuuccccuuuuuuuucauaauaguguauuauagauaaaaccacuaacucauaaaaugggaauguucccuuguuuuguuauggcauaucuugaagcucaaaggcuaugcauguugauuuuuuuuuggguuuagacauaauaaggaaggcaagccacuauuugaggucuugaaacagaacauguuacucuuuucaaucuuuugauucagaauauuuuauuuaacaagugaaucagaaccuugaauuuaaggaauuauguaacauuucacuaguucauuauguauggcguuaagcagaguuacucuagauauccaaacugcuuuucugguggagacuuuuaaucccaccccccccaccccccacccccgccaacacacacacacacacacacacacacgcaugcacacacgcacacacacacacacacacacggaaaguaaccaacuugucaaagaaaaaauacaacaaaaugaaaauagcuuuggcccuuauaauacuuuccauuuauguucccuucauauuuuuucccagugagaaaccauaugguuugugcuauagcuucucuugaaaacuuuguuagcuauuuaacaaucucacuguaacugagugaaagcuuuaaucaagaacugcccaugacauauagaugccuuugguucauuggcuacuucuguaguugaaaggaaguugaacuauuuuuuuggacccaguaaguuuguccuuuccacuuggguguugaaagagcuuaugagcaguagcuguucugauuuuuguugguuguuuucucuagggaacaagcuacccucugagucagcacuggacuugaagauaaauccuacaauucaugaaacugacugauucgacuaaaggauggauaguuugggcagcguuggacagcucuaugaggggucuguuuguuuaacugaagggauuguugaguucagcaacuuuuaauuccccuaaucauaagggguugcuguugugaaaacaggguuugugaaggaaucaguucuggcaauuaacaucaguauucuuacugacuucguuuuuauuuuauugucaaacuucuuuaaaguggauaaauuuuacugcuuuuuuugccagcaagaauuuguaugcacugagaggucagcauagaagcuuugcagucuacuuaugaauccaaguuucuuuuuuuaaaauauaugagguuauaaacauuucucucaaguaaacuuuuugacacuuggauuauuucaucuuuacaaagguaguaugcauuuguggcuuagaauuuuuaagauuuaauggaacuuaauuugaguaguaaauauuuugcuaguuuagugaguauauuuuggcuuauggcuaacaugcuuuuuagauaacuuuuauuaauaagauauaaugaauuuuuacccuaaaacuuuacaggcuuuuaaaaaucaaucuuugaggaaaugagauuaauuauaauguuuaauuauauggauuuuuaaucugaaacaugagggauuuaagcuacagaauaaaaagcuucauacccuaauuuucugggccauaauuauacagggauacaguggauugucuuuuugaagauaaaacaugcugugggaugacauagaaaaucccaaagcugugucugugugauaacgcauauaauuuuguuauuuaagaauuaaaagauuauaaauguauaaauuuuauuuuaaucauuugaaaguugggaugguugaaaauauauaggaguaaugauaguauuaccuagccaguauuugaguagauucuuuaaauaucuuugauugauuaggcuagaaguacaaauagucauccaucauggcagaguuuagaaaauugggcuuuagacaaaugaguuugcagaaaauucaacuuucgcuccauagcugcaugauucuuauuaccuuguuaagcuugauacuuuugauuaagaacauuuuuugccagauuugauuuucucugcaaagguuaauuugauugaaaaaaugaaauuauuuugaggaaagaaguaaaggcuaguauuauuuuagugucuacuuucugauucuguugauuuuuggauggugaagugguugguuuuauauuguacacucuauucugggaugagauccauguuuaaaacauacauaugccuaugucuuguuugucccagucauaucuuuauuuguguccacuuuuaaauuuuccuuuucggccggaugugguggcccaugccuguuaucccaacacuuugcugggaaccgagguggcaagguugcuugaguccagaguucaagaccagccugggcaacauguugagacccugucucuacaaaaaauacacaaaugagccaggggugguggcaugugcuggugauccaagcuacuagggaggcugaggcaguauaugauugcuugagccugggaaguugaggcuucagugaaccauguuggcgccacugcacuccagccugggcaacagagugaaacgcuguuucaaaaaaaggacaaaagaaagaaaaaagaaaguucucuucaacagaaggcuguacuugcauauaguauauagucaucuggagcuugggaauuuuuuugacuagguugcaucaauugcaaauaaugcugugacauucaaacuuuaauugcaauaguaauuaugcugaaauaccuuccuuaaacucaguuucuucuucuauuaagaagagccagugauagaaauggucugaggaauaaagcuugucucugaagcacugaaauaacaaguggugguggcaggggugggguugugagggaggcuucguugaacucaacuuuggauaguuuauuuauuucuacucuuugaaucauaaggaaaaucaaagaagagacuuuauuaauucuuaacauguuuaggacucuuagaauuuggggauauaaacacagugucuguguuuugggcuauaaguguguauucuuuaauuuugggugauuuggggaauuugguuaaaaaugaauaaguauuuguaguaguagcgcauuuuuuguauuuugauuaugauuacauaaguuccuuaguaugauuuuucucauggcaaaagccccagauauuggccuuguuauuaagaagauaaugcuucacauguucucaagucaucuguucaagaugacauauguuuuauuaauuucuaaucuaaaucauuaucuucaauguaguuagacaugacaauuuauuauugaggauuuaguuugguuauuggaacuucauuaaaacuauuuguauaacccauguuuacccagauugcauugaccuagaaaaaguaacacauacuagaguaaugagacuuugucagaagaauguccuucaucccagcuuccuucacauuccucuauuucucucguagugucuaguggguuguuucauguuugcuuuuaaauaguauugacugacauaugugcugcuugauagcaugaucauuuacuuuuccucugcccccagauuuuuguuauacuuaguacuucuuccgugauggccuuugucagugcaggcaauuugaugaugauagcuauugcuguauuuagcaucuugguuguugguaccaagaaaagaggagaucuucaccucuaauccauuuuuuuucaacaaaauuauuuuuuugaauaauuucccaucuacacagugugccauuuacauguguagaugggaauacagagaggauuaaggcacaguucuuccccauagaacaauugaaucacaugugguauuugcagcaaaaagaagaacaaagugaugggaauaauuuuuagauaugggugucaagaaaaucuucaucaagaagguauuucagaaggaugaacuagaauuuacugugagguugagguuuagaguauuugguguuggcaaguacggcuguugauguaugagaggaaggagaagcuuuuuugauguguggguacaugaagcaucauggugucuucagagaagcuguaucaaucuuuagagaauuugaaaagaaucuucauuacaguauugucuuccaaucugugaacauggauggguucucccucuccaguuguucccagguugucuuuaaugucuuuccacaaaguuuuguaauuauucauguuuaggucuuauacauauuucguuagguuuauuuuguaucuuuauacaggaugcuuuguaguacucacugguaucauaauuggugucuuuaaaaaaaucuuuuaaauggauuauuucugauguuuagauauaugguaaacuuuuguauuuggucacccugauaaacucuuauuucaaauauuuuguagauucuuguauuuggaugauggcaaacaaugauagcuuuauuucuucccuuccaguuuuuuuuccugccaucuugugcuggcuagggccuuuaguacaauguuauagagaagugcucauaguugauauuuuugucuuguuacugauuuuaaaaagaauguuuuugauauuucccuauuuaggaugaucuucacucuggaaucucagaugcacuugauuuggauacccuuuuuaacuuuucugguugaagcaaauauuccagauuuuacuggaauggauuuaaaaccuugacacuaauucaugaggcauuuauucagugacuuuuaugggccaaaaacauaagcaaaacaaaaauuuucacuuuuauggaauucacagcuuuuauuuuucauuugugucugucuucauuugaauuacuuacacuuugaauuacuugccauuaucauaaugaaaauguuuuaauugguagguguugcuacauugacuuaaaaagauaccagaagucuacggcaguguuuauauuccacacagccuuuuaauaauggucugauuaaacuuuuuuuuuuaaucuaugccaaucugagaagaggcuaacagugagccacuuuuaauuucuaucucuuuagguuuuguuuuuguuuuuguuucuguugugagagggaguguugcucugucauccaggcuggaguguaguggcaugaucucggcucccugugaagcccgccucccagauuacagugauucuccugccucagccuccugaguagcugggauuacaggugugcgccaccacgcccaacuaacuuuuguauuuuuaguagagcgguauuucaccauguuggucaggcuggucucgaacuccugaccucgugauccaccuuccucggccucccaaagugcugggauugcaggcaggagccaccgcaccuggccuaguucuuuuuuuaaaacauaaacucuuucagaaaagaugcaucuuuuuaauuagcaccagaugugagcaucuuuuuauguucgaggcauuuuucuuuucugcaaacuggcuaguuguauaauuuguucauuuuccacugcuugcuuucuguuuucuuuaugauuuuaagaacuguagguuaagcagacuagcccuuuauuaaguguugcagguaucuuuuuuuguucuguagcaauuuuugucucuugaagaaguuaaauugaugaacauuuuauuuuuugaccuucggauuuuguuucuucauaacagcauauuuuaaaaaguagucugagaguuauuuuauuuuaaacucuuaaauauuuagucugaauauucaugugaaauuuauguggguguaaugaaugaaagggagauucacuuuuuuuauuuuaucuauauaaccaucuguuuguuuauucacuuuauuguuuaguaauggcuagcaaguugucacaucugauuauugagcaggucaucuccucccuugaagucugaauauaacauaaaguauaaccuuuauguuuuacugacuuuauauauacauauuugagaucgguuuugguguccuauucuuuugcacuauucauaugagccucuaucaaacaucuaucuucauuacuguagguuugaucauuuuucagugucuaaugguguuauggcccacuuuuaucuuguuuuuguuuuuuucuuuuaaauuuucugcaauuucauccuuaauuguuuuucuuuucuucaguaguaguuuuuuucuggcuauucuugaugcuuuuuuucccccacauagauauaauuagcuugguuaauauuuuuauuuuguuuuauuuuauuuuauuuuauuuuugagauggagucuugcugugucgcccaggcuggagugcaguggcgcgaucuuggcucacugcaaccuccgccucccggguucuagcaauucuccugccucagccuccugaguagcugggauuacaggcaugcgucaccacgcccggcuuauuuuuguauuuuuaguagagacaggguuucaccauguugcucagacuagucuugaacuccugaccucaugauccacccaccucggccucccaaagcgccgggauuauaggcaugagccaauguggccagccagcuuggcuaauauuuuuaaauuuuguugguauuuuuauugagcuagcaucauaauuuuagauuauuuuaggguagaauugacaucuuuauaacaaaugaguguuuauuccccuuuguuuaaguaaucuguuauuucugucaguagguuuuuauguuuucuucauacaggucuuauacaguucuaguuguuuauaucuacagauuuuaucuuuuuuguugcugcuaguaaauguaaguggguuccuuuuuuuuuuuacauuguauuucauuguccccccaacaccccucccacauuugauugauagucuucuugaucccuuuugauuccucuucccuacccccaagcagugauuugaauauuaauuuuuucauugagauauaauucacauaccauaaaaucaauccuuuuaaaguauguaauucaguagguuuuaauauaucaaaagaucauggaaccauuaccauucaaauuccacagcauuuucaucaccccaaaaggaaacuguaucuguuaaccaacacuucccguuuuucucucucuccauucccugaaaaccacuaaucuauuuucugacuuuuuauagauuugccugugcugcacauuucauauaaauagaaucauauaauauguggcuuuuuuaugucuagccucuuucagcuaauguuuucaagguucauccguguuguaguguaugucaguauuuccuuccuuuuaugggugaauaauauuccauuauguggauauaucauauuuuguuuaccugcuuaucaguugauagacauuuggauuauuuccacuuuuugguaauuaugcauaaugcuacuaugagcauucauguacauguuuuugugcgaaccuauguuuuuagugcucuucgguaauaugccuaguaguggaaucacaauuccacuguuagggucauagcaauugauuauagccauccuaguguguaugaaacaguauauuauugugguuuugauuucugugucccuaaugacuaaagauuuugaggaguuuuccaugugcuuauuggccauuuguauguguucuuuggaaaaaaauguccauucaaauccuuugcccaguuuuaaauuuacuuguuugauuuuuuuaaaucauugugugguuuuuauauucuuauucauacuagaccuguuuuuuuuaaauugauacauaauaacuguacauaauuugcugguauguguguuguuuugauacaugcauacaauguguaaugaucaaauuagagaaauugggauagccauucccucaaacauuuguguugggaauauuucacuucuucucuucuagcuauuuugaauuacacaauaaauuguuaacuguagucaccuccuauacuauugaacccuaagucuuauuccuucuaacuguauuuuuguacccguuaaccaaccucuucagucccccacccaccaacacuucucaacuucugguaaccaccagucuucuuucuaucucuaugagaucuacuuucuaagcuucugcauaugagugagaacaugcaguguuuauuuuucuguuccuggccuuauuucacuuaacauaaugaccuucaguaccaucuuguauugcugaaaaugacaggaugucauuuuuuuuaugacugaagaauauucuauuguauguauguaccacauuuucuucauucauccauuaauggacacuucaguugacucuguaucucggcuauugugaauaguccugcaauaaacgugggaauguagaugucucuucuacauacugauuucuuuucuuuguauaaacccagcagugggauugcuggaucauauggcaguucuguuuuuaguuuuuuugaggaaccuccauacuguuuuccauaguggcuguacucguuuucauucccaucaacagcauaccaauguucuccuuuuuccauauccucaccaguauucauuauuuuugucuuuuugauaaaagccacuuuaacugggguaauaugaucucauugugguuuugauuugcauuucccuggugauuaauaaugcuggacuuuuuucauauaacuuggucauuuguaugucuucuuuugggaaaugucgguccugaucuuuugccuauuuuaaaaucagacuauuuggauuuauuuuuuuauuuuuauuuuuauuuuuucuauugagguguuugaguucuuuauacuaaucaucaauuucccgaugaagggauagugugcauauauauucucucuuucugcagauugucuucacuuuguugauuguuucuuuugcggugcagauacuuuuuagucuaauauagucccauuugucuauuuuugcuuuuguugccuaugcuuuugagaucuuacgcaaaauaucuuugcccagacugauguccugagggcuuucccaauguuuuuuuccuaauaguuucaagucuuaaauuuaagucuuuaauccacuuugauuugaucuuugcauaugguaagagaaaggaauauagcuucauucucugcauguaguuauccaguuucccaaacaccauuuauugaagaggccaucuuuuccccaauagguguucuuggcaccguuauggaaaauuaguugccuauaaauauguguauuuauuucaaguucuguguucuguuccauuggucugugugucuguuuuuaugcagguaccauacuguuucgguuacugugacuuuguaauauauuuugaagcaaguaguagaugucucgugcuuuguuauuuuuggucagaaugcuuuggcuauucagguuuuuuuaguuucauaugaauuuuguauuguuuuuucuguuuauguaaagaauguccuugauauuuugauagacuguguugaaucuguagauugcuuuggguaguauuaacauuuuaacaauauuaauucuuccaauucaugagcaugggauauguuucacucuuuuuguguccucuucaguuucuuucaucaguguuuuauaguuuugcuuguagagaucuuucacuucuuugguuaaauuuauuccuagauauucuauauuuuuuguagcuauugcaaaugggauugcuuucuugauuucuucuucagguuguucacuguuggcauauauaaauguuacugguuuuuuuaaguugguuucauauccugaaacuuuuacuaaguuuguuuaucacuucugacaguuuuuggguggagucuuuugguguuucuaaauauaauaucacguugccuacaaacaaggaugauuagauuuagauuuuuccuuuccaaacuguuugccuuuguuuuuuccucuugccuaauugcuggggcuaggacuuccaguacuauauugaauaaaagugaugaaaaugggcaucuuugucuuguuccagaucuuagaggaaaggcucuuuuuuuuuucuuuuuaaauuuaagacagggacucgcucugucacucagaccggaguucaguggugcaauguuggcucacugcaaccuccgccuccugggcucaagcaguccucccaccucagccuccugaguagcugggacuacaggcgcauaccaccauacccuaauuuuuugaauuuuuaguagagaugggguuucaccauguuguuuaggcugguuuaaaauuccugagcucaaaccaucuuccugucuuggccucucaaagugcugggccagaggaaaggcuuuuaacuuuucucauucgauaugguguuagcuguggguuugucauauauagcuuuuauuguuuugguguaaguuucuuuuuuacccaguuuguuguuuuuaucauaaagggauguuaaauauuggcaaauauuuuuuucaacaucuguugaacugaccauugcauguuagaccuuuauuaaauauaugauuugcaaauauuuucuccuauuuugugaguugccuauucacuuucuugauaguuuccuaugaguuacaaaaaguuuuaaauuuugaugaagccugauuaaaaaaauguuuuugguugcuugugcuuuacuuguccuaucuuuuauuuauuuauuuguuuguuuguuauuuauuucuugcaucugcuccacuggcaauacuugucuuagcauaagaagccauugcucgacuaaaagucacaaugguuuauaccuauguuuucuuuguuguauuuugugcauuuagguuuuugauucauuuugaaguaauuuuuguauaugguaugaaguagguguuggauguuauauauuauguuucuguuucacguggucaccacuagauuuuuaccauucaugcuuuaacuaaguauggaauuguugaagagaugggcaguaaaaauauuaacgcaagauuuuuauuauuuuuuuuuuugagguggagucucacucuguugcccaggcuggaguacaguggcgugaccucggcucaccacagccuccaccuccuggguucaagugauucuucugccucagccucccgaguagcugggacuacaggugccugccaccacaccuggcuaauuuuuuguauuuuuaguagagacgggguuucaccauguugaccaggcuggucucgaacuccugaccucaagggaucuacccgucucagccucccaaaguguagggauuacaggcgugagccaccgcgcccggccaauaagaauuuuuaaugacuuugagccuuccugucccccuucaguguuuuaguuaucuagaauuuuaguuacacuuugacuuuuauucuuuuacugucagugcuuauucaaauuuucucacauauucuuacauuccaugccuuuuaagaggggaguuuccuuuuuagugaaguugaucuuuuaauaguucuuucaccauggagaugcuagugacaaaccuuaaacaugucucucuuucuucauuuguagauuguauauaaauuucaaguagacaguuaucuuuucuccuuugaaaauuucauuguuuaguguugcugauacaguuagcauaauuauuuuucuuuuguuagaucauuugucucuuuucugguagcucuuaagauuuucucuuugucuuucgcaugcugcauuuuugcauaauugguagaaaggacuuauuuugcucagaacucuuuuuuuuuuuuuuaaacagcaucucucugucacccaggccugagugcaguggcacgaucauagcucgcuuuaccauuuuccucccugggcuccagcaauccuuccaccucagccucuugaguagcugggacuacaggugcauaccaugucugguuuauuuuaauuuaauuuaauuuuuuuuugagacggaguuucacucuuaucacccaggcuggaacaguggugcaaccucugcucacugcaaccucugccucccugguucaagugauucuucugccucagccucccaaguagcugaaauuacaggcauguugccaccaugccugacuaauuuuuguauuuuuaguagacacgggguuucagcauguuggccaggcuggucucagacuccugaccucaggugacccacccgccucggccucccaaagugcuggaauuacaaacaugagccaccgcacccggccuaauuuuuuauauuuuuuguagagacgggguuucaccauguugcccagacuggccucuaacgccuggccucaagcaguccgccugcgucagccucccaaaaugcugggauuacaggucugagcuaccacauucagccucugcugagaacucuuaacuuagaacuucuugagugaggaguugugugcugaguucuugaaaaucacaauucuuuuuuuucgaauguugcuucuccaguauucuuuucuucuuuuccuggauauuuacauuuucauuauuuuguaucucuuaacugcucuuuuaaauuuuccagguuuuauuucugguuaauuuccucagaucuuuauuuauuuauuuauuguuucccucuuugauuuaucuaauuuauuguuucacucuuugauuuaucuacuuugcuauuuaaugcaucuuuugauguuuuuucccuuuaauuuuaaugcuuauguuuucacucuuaaagagccagugcacucuguuuuagaauuacagacaccuuauucuuuugugauguuugucacuucuuucauauucuuaaucaccuccguaguaauuauauuuuauaaucuguuuuauaugguucuguuaccuggacucuuuguucuuguguugcuaauucucaaguauguuguacaugcucguucuuaugaguucuuuuaagugcgauuauuuucuguggaagguucuuguauguugucauuuuuguggaaguguucaucaaaauaguuugguguuugcuucagcaaggugucugaagaguuuuuccaaagcaggucgaguauuguguugauuucuugucgggauuccuguaacauggaaucucaugaggauuuucucucuuauacuuaugcauggaacaggcaugugguuuccauuucucuuaagacgucaccccaguccuccaaccuuccuccuuuuucuccauugcucuucgacagacaggcuucccuuuuuguucuaugagcugauagaaauguccuguauuuacugcuuuuccagaguccugguuuuacacagcgguuuuaguuucauuuucuguauucugugggcucauggccacauuucguguacccuugugggccuuagaaacucaacuuguagagacuguaucugaccuagcuuauaauuccccaaacuccacgacauaaccuccuggcuucagauucugcuuuaguuucuugcucuugggguugguuuguuuguuuguuuguuuguuugguuuugagacagaguuuuauucuguugcccaggcuggaguacaauggugugaucucggcucacggcaaccuccaccucccagggucaaaugauucuccugccucagccuccugagcagcugggauuacaggugcgcaccaccacacccagcuaaauuuuguauuuuuaguagagaugggguuuugcuguguuggccaggcugguuuugaacuccugaccucagguggccugccugccucagccucccaaagugcugggauuauaugugugagccacugcgacgggcccuuuuuuuuuuuuuuuuuuuuuuaagaucagguauauuuuaaauguugggauguuguguuuuaucucacaguucuguguguucauaacauugguagggguugagggaggguguccauguuaguuuagucucucauuuuccagaaauaauauuguccuaacugguugguuguauuuaggaagggugcugauuugguauauauuaauuuucuaaucauuaaugaauucuguaauuauuuuccaggaguuuuuuauguuguuucucuuagguuuuccagaaauagaauuguguuauccaaaaaaacagugaugcuuugccuuuauagauuagccuugaaguuuuuaaaaucucauuucuuucuuuuguuaguuccaguuaauuucuccaguagacauuccuguguuguuccuuacuuuuauuugaauuggguacuuuugagaaucauuuuucaaaugcccuaaagcaguuaauuuaucauauauuacuuuuaaauaucucaguuugcauguucacuuuagaaguuacaguguaauuauuguauacugaugucaucagaaugucauuucaagaguaaaugacaaaaaaaaauacaaaaaaugaaauacgaaagugaaauauucuuaauuuagaauauuuaaaauacaaauuuucauccuucuagauuguuguuaugcugaucuucuauguauuacuauauuugcuguagugcucuguugauugagugucaguuaauaucaggguguuccaguaaccauugguagcccuuucccugcuguauauggaaagauugaaauuauacaagaauauuuaugugugaaacaugaaauuucuaaugaagaagaagaaacuucuauuacaguguaucugauguaccucauuauuaaaagaagaccuuuaguuuuauuauaucaaaugguuuccugaaacccuuuuagcguaagauuccugugguuaaacauuaaauaauaugcaauggaagaugucauuuuaaauuaagaauucuuaacuuucaaucagauuuucuuaauuugagcagaaucugcucauuuuaauucagcauccuauuuuaaacuacuuguuccuguagugugguucuauucuuucuugcuguuuauaauuuaguacuguauguaggcacuuaagaaugggcaucuuguuaguauugucuucauaauacuaaauacagaauaccucucuccaaguggauguguagauauuuuacucaguucuuuaacacacuuauaaaauauacagaugacacaaagcugugucuuuugugauuagauuagguauuucaguaauuuaguuuuuaauuuccuaugcaauuuaaguauccuauuauccuuauuggcggggguggugaugcuuacuguuguacauguuuuauuuugaauguucuuucuuugcuuuccuuuuuuuuuuuuuccuuagagagacagggucucgcuauguuacccagacuggagcacaguggcuguucaugggcgcuuuguggcucaugcagccucaaaccccugggcucaagcgauccuccugccucagucccccagguagcugggacuacaggcucacaccacugcacucagcuuacauuugaauguauuuaaguaacuccagucagccucagcucagaugaacucaaauuuuauuucugcaacuuuauauuaaaauaaccucacaaaauuuagaauucuuaagagaacucuugauacccuauaguaaauucuacuauaggugaauuucuaucuuaacucaccuuagauuguuuuuaugguaaucucuuuccacguacucagccuugaagagagauucuacuuuuugucucacuuacauaccuacuuugaugucagaaucuuucccuucagccaaugcuacacauagccccauccccacguagcuuuaguagucacacuaaagcuaguaaaacauguaauugauuuccuguuuucguauguguguaagacuuaggaauuggucaacuauauagcauguuggcugagagcacugacuuuggaauuaaaucaaccugaguuugagucuugauuauguugcugaauuaccuauauuuguccuuacaguaauuauuuugaucuuuuaaguuaguuucuccucugaaauaaauaugcuauaccuaccucacagggugguugugaggauuaaguagauugauggauguggagcacuuagauuagugccugaaacauugaaagggcucaagaauuguaguucuguuguauuacuuaaugucauaauaguaaacaaauuuacucaucuuugguuacuuggccaguuuauuuuggaaagucuuagagacuagcuuuaggaaaaucugucuaaaugcauuucauuuuagacaaguagggaguuuuuauccauugauaauagucuaauauaauuuuugcuguauggauuaaccuuuaauuaacuguacaauauagaguuagauuaaaaacagcucuggaauaguuuuuaaaaaauaaaauaaaagguuuauauaaauauaguaauuuggcuucauauuuuuuuuaaggaguuuggguuuuuuuaaaguuucuuuuauacacauuuaagacauaacucgagaauuccuauccuauuuuaaucucaaugcaguagacauuguguuauaguaaguaggaguacuagauugggaauuuggagaguugaguuugagucuuggcuuugcuguugacuuugcauguauguccugugguguuuauagccugauuuaccucaccuaccuacuuuaguugcucagaaaaccagaaauaauuauguugaggcucuucagaaaguacagagggcuauccaaagaaaagaaaaguauuaccucaguucucugcuuauuuuuguucaccuacauguuuucagaaaacauguugguaucuuaugaauuauuagaaauugaaacucauaucccuguuaaucauaauuuugugacuagggcauuuuugguagcccuuuucuuauauugugagguggcauauuauuucaguggugaagguuuuuaggcauucaccaaauagccagaaaacaguuccuggauaagcuuauuuuuuucaggaaggguaacuguugcucuaaauacccuuuucagucugcucagaacugaucaccuccauuaagccuuugauuaacgcuaccugguuuuaauuaauuugcauuucaucagcauuuaugcauguaguuuguaguguauuaguuuauauuuggguuuuuuuaaguuauuuuaugucuuuuacaugugaccuggucuuuuuuucucagcuagcuuggaaucuccugaaggguaaagacaauuguccuuucccuuucuucacaauaaacucauaauagagggcgcuuugcacauaauguuucuuacugguugugguuguuccacuggaacauagugguuguuccacuagaacauaaugguaucaauuggccuaauucuaaauaguaugcaucuguagaaauuuucagaguaugccuguuuagaguuaaugacaaaaaggcaucaaaacaacagacugcuugauacuaaaaauauggcacuuaagcugcuauguauuucaacuuuuuuuuuuuugcuuuuucaaacaauuuuguuaauuauauuuggcugaaugaaaucuaguagcucuucauuagauaauuugaauuuuuaauacuguaauauauuuggggaaugugcuauuuguauuguuaaugauucuuaauaaaaaaggaauuaugccuuuuauaaaagaaaaacuuuuauaaaaggcauaauuuuauaaagagccacaauucuguuacuucccacucuuccauuaauuuauuaaauuuuuggucacucuugcuauuaaauuuccugauguaaaccuugauauggaggagacuauucuugcaguaaaucugcuaacauauuuggaaauaaguacauuugaaaaaagaaacuuuacauuugcuuuaaucagagcuuuuucuacaacaaaacaagauaaaauuauuuccuucaucuuugcacuuacgaucccaaagaugauguuucuuccaaaugaauguuugcauuuuauuuuccagacuuguucucuaaaaccaauuauugcuccauuaagaaacauuuuuacaucuucuucaggaaugucguugucugcugggucuuccccucuucauucccccaagauuacuccacauacuucuccugcucccagaagaagaagucacacuccaaauccagcaaguuacauggugccuucuagugccucuacaucuguuaauaauccuguuucucagacuccgucuucuggucaggugauccaaaaggaaacuguuggugggacgacuuacuucuauacagacacaacuccagcaccuuugacuggaaugguaugucuacauuaaagaggaaauuuuaguacucucuuguaacaggaccuucuuaguugugaggcggucuacccccuccugcagcuuuuuauugugaugcaaaaaaguauuucauuuucuaacuuagaugagaagucuagucucuucuucucaacucuucaaauuaaucuaguucugccuuacuaauaauucuaguuuuggacuaaacugguuuaaucagaaauuagauuauauccaugcucuuauuuuagucuuuauggcauguuuugcuuauggguuuaccuuguacuagcuggaauugaugccugcugacauuuguuuauagguauagauaguuuaaccucaguaagaagcuagaaaaaguagaugguauguccucaguaguuacuggaagcaaaucaaugauaaacccuuauuucagaugagguaguuauuuaacagcuagaucuguggaugguggagugacacauaaugauaaggggccugcaguauggcucuuaugcucaggagauagaguagucagacccaagagagccaugauuguagaugacgaaagagcuaccaaaggacuggcgaugaagugagggaagaaucgugaaacaaaugggaagagguggccccagaggaaacaugaauauuaagaccaaaagaggaagaacauggccagaaagaaagauuucuuaucagagucaauuaguaauguuccaggagagggagaaggaacaggagucagggggcgagaaugaauggggaaggagagggaaggauuccauguuacguaaauuguaccuuuuuuagcuucauuacuucauccauauucaaaaauuauuuuauuuacccuagaaaaauaaguaguagaugaagugagugagaaagucagaguccacuaaaacagggguccucaauccuuggaccagagaccaguguuaggaaccaggccgcacagcaggaggugagcagugggcgaguaagugaaguuucauccguauuuacacccacuccccauugcucucauuaccaucugagcuccuccuccugucagaucagcagaggcauuagauuccauaggaacaugaacccuauuguaaacuauaaauauauuguaaaauacauauauauuuuauauauauguaaaguuauuaaauuauauaaauauauauuauauauauuauauauaauuaauauauauuauauauaaauuauauauaauauauaauuaauuauauauuauauauaaauuauauauaauauauaauuaauauauaaaauuauauaaauauauauauuuuuugagauggauguucgcuauuucacccaggcuggagggcagugguucagucuuuguucacugcagccuccgccuccuggguucaagcauuccucucaccucagccucuaguagcugggacuacagacgcacaccaccaugccuggcuaacuuuuguaucuuuaauagagaugagguuucacccaguugaucaguuggccaggcugaucucaaauucuugaccucaaaugauccgcccaccuuggccucugaagugccgggauuacaggcgugagccaccaugcccagccuaaacuaugcuaucuuauguaaggaaaccaacacaagaaaaaagagauauuauucucccugcagacacaggcuaaaggaaaccuuacaaguaucacaaaacugcuuccuaguugagaugcagagcagagcagucauguuagggcagcgcaaaucagcugaauucguuuuuaaaagagaaaaaagguuucauuguuuaaaaugaaagaaugaaaaaauagaaaagauauuuaaaacugaacuuugauuuuguaucauggaccagugaaggagaggcagagaaaagagugauaaagagaacaaaggguggugggaugaguccaguugaaagaaugaaagacaagaagcuggaagcugauuuaguaacuuuauuguaguuugcuuggaagguaaauguauuauuguauccuucuguucacuuaaacugcugaccuagaguagguuugaauaacacuuuguuuaguuuggccacaaaaugccugugaaaggggaaauucuuugggcagccagggcaauaucacuuccuuaucucccaguacccaaacaccuuuaguuucuccuuccuuccuuccaguugcuuucaaaaaguggcgaugaacugcuuguauaguugccauuuaguauccaagggggauugauucccggacgcccacagauagcaaaauuccugggugcucaagucccugauauagaaugacauaguauuugcauagaucuuauacacauccuccuguauacuuuaaauuaucucuagauuacuuauaauaccuaaugcaguauaagugcuuugugaauaguuguuauaauguauuuuuaauuuguauuacuucucauuuguuguauugucauuuuuuuccccugaauauuuccuacccaugguuggucgaauccuugaauacagaacccagggauacagaaggcugacuaugugacauuucuuccaaagagcuacuuuuaucuucucaauggagcuuaaauuuuacuguaucugaagaaauguuuucuuucucauuagauuuuuuuuuuuuuugagacagagucuuccccugucccccaggcuggagugcaguggcacgaucucggcucacugcagccuccacuucccaguuucaagcgauucuccugccucagucuccugaguagcugggauuauaggugccugccaccaagccuggcuaauuuguguuuuuuuuguuguuuuuuuuuuugagauggagucucggcucugucaccccagcuggaaugcguuaguucaaucuuggugcacugcaaccuccaccuccggguucaaaugauucuccugccucaaccucccgaguaacugggaguacaggugcaugccaccacacccggcuaauuuuuuguauuuuuaguagagacagguuucaccauguuagccaggauaauuuuuguauuuuuaguagagauggaguuuuaccauguuggccaggcuggcucauuagauuuuuaauugauuacugaaauauuauguuuauuuuuauuuuuuuaauuuuuuauuuuauuuauuuauuuauuuauugagacgggguuucauucuuguugccuaggcuggaguacaauggcacaaucuccacucaccacaaccucugccucccugguucaagugauucuccugccucagccuccugaguagcugggauuacaggcuugcgccaccaugccccacuaauuuuguauuuucaguagagaccagguuucuccauuuuggucaggcuggucucgaacucccaaccucaggugaucugcccaccucagccucccagagugcugggauuacaguugugagccacugcgccuggccgaaauauuauuuuuaauaugaauucuuucagaaaguauucucuaacagcuauucucugagguuuuuacuucaauauuauuuaaagauuuaaaauguauuaaaauuuauugcuaucauguaaagauuaaaauuuuaucaaaacaauaauaaagcuuauugauuaugaaaaauuagucaggcugggugugguggcucacaccuguaaucccagcacuuugggaggccgaggcagguggaucaccugaggucaggaguucaagaccagccuggccaacauggugaaacccugucucuacaaaaauacaaaaauuagcugggcaugaugguggguaccuguaaucccagcuacgugaggcugaggcaggagaaucacuugaacccgggaggcagagcuuguagugagccgagauugcgccacugaacuccagccugggcaacagagcaagacuccaucugaaaaaaagaaagaaaaaugagugauuacauuuacccccuuccuaccuuuuuagguguuuccaaacuaucauauuuauccuccaacugcaccucacguugcuuauaugcaaccgaaagcaaacgcaccuuccuucuucauggcugaugaacuccgacagguaugcuuucagaauucauaguaggaauacuuaaugucuccugugcuuuagugaacaggggaaagaacagagcucuuuucaaaucauauuauuuaaucaaauaugcucuaguaaagcacaucgaauuuagaaguuuuaauugguauuuuuuuuaaggaaaccugucuuuuaaaaaaauuucaaauaaauuauguggcaggauauaaaacauagaauagcuauuuaaaugguucacuguucuguacuucauuuuauuucuaugaaaaggcucuuugaaguauauaaauaauuuaaaugguuucuaacaguauuuuucuaauagauguagguuaaaaauaaguaguuuggcucaggaaauaacuuuaagagagcucaauauuuuuuuaaaagaauguuuuuuaaaaguuuuuuuguuuuguuuaauuuuugguaaacagcuaguuauuugguauguagaauuucacuuuacacucagauucucagaaauauuuuuguuucauagaagugaguucuaccaguauaguguuuuuuaaauuaauuauuaccaguuuacuaguagaccuugaauuuucagccacagcguuagucacguguuuuggguagcccagcuacccguguuuaaggggcacaucuacuuaaacccaaucuuaauuauggcaugucuaagucugucugggccuggaguucagacauuuuaccauguuuagaaauguuuuaauauuuaaaugauuuuaauauuuaaaaagugcauaugccaaaaauauuaauacuuagguuauuuaauuauaauaggaauuccagguuucagaaucuguguuuaaauaaaaauauacuuauuuuguuucauaggagcugaucaacagacauuuaauaacaauggcucaaauugaucaagcagauaugccagguaaaaagcaaguugauccuuccuuucuuuuaaaggcuguuauaauucuuacgugguaguacauguuuuaugcauuauuaagaagaguuccaggcugggccugguggcucauaccuguaaucccagcaguuugggaggcugaggcaggaggauugcuugagcccagaaguuugagacuagccugagcgaaauagugggaaccugucucuacaaaaaauaaauuagcugggagugguggugcauauuuguagucccagcuacucaggaggcugaggcaggaggaucacuugagccuugaagguuaagacugcagugagcuggcuauaaucgccccacugcacuccagccggggugacagagugagacccugucucaaaaaaaaaaaaaaaaaaaggacagucccaagguacuacugaucaucuaguuuauuucuguuaauucuacauaugacaguauucuaguucacaaaaaaaguauauaauuuuagaauucauggugauuuacuuuacugugcaccagaauauuuuuaucuccugaaacuuaaugaaguauggguucuuaagcaggagaggaugguaauuauuaggccuauuugugagacuacugugugccagacaguauacuaauuaaauacuuuacaugucuuacuuuauuucucacaaacauccugugacauauuauuuucauuuccauuuuacauaugaggaauacugaaguugacagguuaaguaacuuaaccuucaggaccaauggcugguaaacagcugacugauuccagacuuaaaacuagguuguucuaacuguaccacaauauuucuuaaagcguauuaaaguaucuuuccuuagcuuacucuguauaaaugaaauaugauauaauuuaguaaaauuucauaaauaauacaguaggaauacauuugccauaaagaucucaaaaugccugcuuguaaucagaaauucagcaucgucuagugaguguugucucuugauugcuaaagaauuaaaagaaauaugucuggcuguuacaccuuaagauggaucuuuccagguaaggugggaaggaacuuacuugucauaaccuuugaaauauucaucuuggaauuuuucuuaacuguuuaauauuguauuugaggcuuuagccagguuuugcaaaaguuuaaaaagaaaaaaaaauggaaggcacaaagaccggaaaggagaaaauaaaccuaccaucuauaaaucaugugacugcagauuagacauuauuugaaauaacaaacuguagaaaauggcuggauguaagauuaauacaucaguugcauuucuguaggccaguacccaguuaacuucaaaauauaauuaaaagcaaaugcuacuuaaaaugguuuugcaauaucaguauguaggaauaaauaacaacaaaagauagguaagauuucagcaggggagauuuauuuauuacgcaguauuaaauaauauaaaugaaauacuguagauuaguagagguuacucaugauuaggaagacagaacaaguaagaugucaauuuuucugaacugacauguagauccaguagaauuccagucaaagcauaacuuccagucaaaucuuuucauggaguaugauaaaauguaucaaagaauaaagggccacgaccauccaagguacuuugaagaguaugguuauuauuuauguucauaugaagaauuuguuuguguauuagggaaggagagguuugauuugagucugcaguaacuaaaucaauguggugauagcacaggguuaaacagauugauuaacggaacagauuagagagagccagacacguucugugauaaaguuggcaaauaagugggggaaaagaaagcauuggaaaaauguuuuugguuuuuuaauuaaaaaaauaaacuuuuauugagacagcaucuugcugucacccaggcuggaguacaguggcgugaucgcagcucacugcaaccuccgccuccugggcucaagcaguccuccuacuucagccucccaaguagcugggacuacagguguacaccaccacacuuggcuaauuuuuguauauuuuguagagaggguuucaccauguugcugaggcuggucuugaacuucuggacucaagugauccaccugccucagccuuccagagugcugggauuacaggcaugagccacugugcuucaggccacaaaaaaugguuuucuauauugacaagauaaaauugggucauuaucucaagccacauuaaaaagucaacuucaaauagauuaagaacuuacaugucuaaaacagaacucuaaaacucuuucuguaaaauauaaaugaguguauuuuaucuacuuuuaaaauacuuuaaaaaauaaaaauuaauuuuaucuacauuuguagcgaugauaaaauauuuaaaauuuuuuugucacguucucuuucaaauauccaugaguacuuuacaugauucaucaguaugcacacaauuuucaacuuagacauuuucaaacaaacaccgcccuauguuucugacuaucccuucccgcguaacauuuguuugcauuauaguucacccauuugacacuugauaauauaguuuuuggcauccugaauuacagugcagugaacauauucaucuacuuaauuuuuuucuucuguaggaaauauuuuuuuccuuagaagaaauacuucaaguauuucuaaacugaucuauagauucaguaguucagaaauacuuuuauaauuauuuauacuuuuaaguauaaaaaauguaaauaauugauaaauugaugcucuuuuaaaaagauauaaaaaagaaaaacgcgccgggcgcaguggcucacaccuguaaucccagcacuuugggaggccaaggugaguggaucacuugaggucagaaguuugagaccagccuggccaacauggcaaaacccugucucuacuaaaaauacaaaaauuagccaggcgugguggugcccaacuguaacuccagcuacucgggaggcugaggcacaagacucgcuugaaccugggagguggagguugcagugagauugugccauugcgcuccauccugggagacucugucuccaaaaaaaaagaaaaaaguaaaguagaagugguuuuaaagcuuauuacauagaaccaaauugcuuuccaagggauaucaauuaaacaccauugauuuguaaguuguaauaauuuacuagcaaccccauagcaaacgagugccuacuauccuugggaauugcucuguucuuuguauuuucauaguguauuagcucucaaaguaugauuccuuaaccagaggcucauuuucauugacuuuuaggaacuuguuagaauugugaguucuuggaucccacuucagauuguaucagaaacucggggaauggggcccagcaaacuauauuuuaacaaggcuuuaggugauugugacagguggugacguuuaagaaccagugccauagcgaauuguacuucuuaaauggcgacuuuaccucuuacauguuuuguauaaauuuguguucuuuauuuuucucuaggccucuugaggguaagaacguaauauuucuuuagguucauuaguacauaguagaugcucaguauauuuugcugauuugaaauuaauccuguauuaagugcuccuuaauaaaugaaauagcuggaaaacaaaauuuaccauuuuaacuuccuuauggacauuauaccaaucauucaaauacaaacuagguaaaugcgcaaaaguaaaaguuacagcuauuucacuuguguguauucuuccguuguacugcuuuuauuuuauuuauuuauuuaagagaugaggucuuaaauguugcccaggcugaauucagcuccuggguuuaagugauucugcugccucagccucccaaguagcuaggacuauagucacaugcaaugacacuuggcaguauacugccuuuauuuaaguagaacaugccacuuggugacauuuaaucauucuacauuuguuuuucauuauggccaugccauguagagauuaugauuauagaaucaaaaaguccuggguuugcauccuaccuuucucucucagcuaugcaauccuuauuauccucauuuaugaaauagggaauucuaccucauggaauuguugugagaauuaagagauaaugggcauaaaguauuuggcaaaugcagaggaaggaucauuuugaaccugucuucuggaauuaguuuucuuaauaggguuucaucuguguuucuuaccagaggucaaaaauuaucaguuguuuuuguuuauaggguuuuuuuuuuuuuuuuuuuuuuuuugagacggagucucgcucugucgcccaggugggacugcggacugcaguggcgcaaucucggcucacugcaagcuccgcuucccggguucacgccauucuccugccucagccucccgaguagcugggacuacaggcgcccgccaccgcgcccggcuaauuuuuuuuguauuuuuaguagagacgggguuucaccuuguuagccaggauggucucgaucuccugaccucaugauccacccgccucggccucccaaagugcugggauuacaggcgugagccaccgcgcccggccgguuuuuuuuuuuuuuuuuuaacagacauaaugccauguuuuaaaaauaguguuaaacauguauauuauaaaacauuuggcaaauacaaaauaguguauagaaaagaauaauaauccucccuuuaaaagguuaccauuguuaccaucugcuauauuuucuucuaguugguuuacuauggcuguacuacauguuggguuaucuuccguucacuuaaaauaucaugagcauuccgaagucauucgagacaguuaacagaaugaaaguauagguugguguucaauuggaaaacaugaugguauuugaagcauuaaaaaauacauguuuuuuuauuauaaaccugauaaaauguuugcuccagaaaaauuuaucucagugauaacucaaauuauuuauaaaaauuauuucugaggaacaaauuuguauugugcuauaaaaggaaauguuuuugaauguaugaacuuuaguuauucuuugguuauuuuauuauauaaugccuauuuuuauugauacugaagcuaguuugucuuauggaauuguaauaaauguuuacacuauucuaaaauacaagagcacauugugauacacaagggguuuauaguaaauaucaugucuucuguauuuuugagaaagauuuaugaaugccuguauuuucaagucaucuucuuaugaauuacucuagcaguuccuacagagguugacagcuaccauagccuauucccucuagaaccacugccaccucccaaccggauacagaaaucaaguaauuuuggauauauuacaucuugcuacaaagcuguaaacagcaaagaugaucugccauauugccuucggaggauacaugguaaggaagauaaguuaucuucuuuuauaaucguaucauugaggcuaagauuauucaaaccuucuugaauauauuauuuaauauaugaauuaaaaauuuuuauuuggaaauuaguaccucaugagcaauguauaaauauggcaauuuuuuuccauuucugauggaauaugaaggagacgucaauuagaguuuacuggaguagaaaaauugucuuccagguuuucgucuuguuaacacaaagugcaugguguuggucgacauguggaagaaaauucaacacucaaauaucguaacuuugcgugaaguauuuaccacuaaagcauuugcugagcccugugaguaacuuguaauuugucuuucugcuggugagcuucauuauuugaagccagcuuucaguaaugaguguuuguguuuuauuuuaagcucuuguguuugcauaugauuuccaugcuggaggagaaacuaugaugagcagacacuuuaaugacccuaaugcugaugccuacuucaccaagagaaagugggguaagaaaaagaugcaggcaaacuauauuuugacuaaugcuuuugcucuguggaagaguaguuuucuauuuuaaaauacguauaauuuuucccuguaaucauuuaguuuaaagacucuauuacauuuuguacuaguuguuuucauguuccugauaaagacauacccgagacugggcaauuuacaaaagagagagguuuaaugaacuuacaguuccauguggcuugggaggucucacaaucauggcagaaggugaaaggcaugucucacauggcggcagacaagagaagugaaugagagccaaguaaaagggguuucccccuguaaaacugucagaucucaugagaccuauucacuaccacgagaacaguaugggggaaauuacccccaugauucaguuaucucccaccagcucccucccacaacacugugggaauuaugggaguuacaauucaaaaugagauuuggguggggacgcagccaaaccauaucacauuuuaaaaagaaauaugucaaagaaauggagaugauggucaagaaguuaggaaauaaugucuuuugcauauuuacuaagauaagauagauuuuugaagacucacauagauaucagauauuuaacuggaaauguguuaaaauuguuuuucucuuuaaaauguuuuucuuuuaaaaauaugaugcuuucuuaauaaaggugacuuggaaaauucaauagcuuagaaauagucucucuggcuucccugccuaaguacaaccauugugaaucuuuuaguacauuucuuuucaaucuugcuuuguuuuguuuuugucuccuuuugcauuguuuuuuguuuuaaccuuuuauaucauauuacaucuuuucuuuauuauagguauuuuccccauaguuuuuauauucucugaauauaauuuaaugauuccuauuaugacuauauuguucuuuauguaauuauuucccuaaacaaaugcuuuuguuugaagguuggauuccauguuacuuaaucuaagguuucaaaauagaauuuuaaguaacuuuuccuuaaacaugaaauauuuucuucuuugucccuuucuaauauauacuuaaagaauuguuuuaucauugagauuuugcaaacaaccagaauacuugaauucuaacaaauguguguuaaaggguaaaugauuucagagaaaaguaaauccauuuugagaugucuauucauuaauuuauguauuuagggaaggucucagucuaugggggcaagaaagcagcaucacguuauuaugcuuuuuaaucuuaagauuuucuugacuugaaaauuaaagaggaggggagaaagauuugaguccauauucuaguaucuuucagauuacaacuccuuucaagacucuaauuauagacaaaaauauauuacuucuguuuacuuguuacuucuuuuuuuuugcauccugacaguugaaaaaagaaaguugugguuacauggcuguuucacauuuaaaaucuggucauagaauguggucauuuuuuuccuuuugcuaugucaucuguagacacaugcauaauuuuguggaaggggaugugguacaacuauucuuauagaugacuauaguuguugcucaaauuuauuuugguaguaacaccugugaaaugacuguuggcuuuaauuuauaacuguguuucucaacugcuuaaguuuuugugggggcugucuuaugcauuucagaauguuuauaguggccucuucugacugaagggccuggcuucugccuacugaaugccaguagcaaucccccucuaccccuauuguaaugccagaaauaucuccagauguugccaaaugcuggagugguuucuuuugagaaccacucuuuuauagcauucuuuuccaguaauuuuuuaaucauaauuauucuguuuuugguguucacugauuaauauauuaauguuuauauuuucauaggaaguaguccuuuuuucuaauaguuuaaaauauuguuugaguagucguaacuucccuaaccauaccauacaugcauaaaagccuaccauuuucuuacacuauguaauuuauuaucuuagcacaagugaaaaaaaaaagcaaaguauaagaaauauauugauuuagaaaaugagaagaauagcauaccauguggaguugauacgagauucagaaugagucuauaucaguaaaacaacuagaacagagucuggcacacaguaagcacuauauguuugcugcaaaaacucuuguuuccuuauuacuacauuaauuaaauaguuucauuuaaacaguucauagucauuuuucacauugucuuggcauuuguuaccggucccauuuuuuugagccuucuuacacauauuuccagaguauauuaucuucuguucuguccaaauugagagauaauuauuuuuaauuuuguaugugcugcuuaccagaaauuuuauuccaagccauaaguacauauuugcuauuuauuauaaguacauaauuaaccauuuaauuauguugcuuuuuauaacugauucacaaaagguuguuuuacaacaauaugaauauaagaucagcaggguguagggacucaugcuugcaaucucagcacuuagggaggcugaggcagguagaucauuugagcccaggaguuggagaucagccugggcaauguagcaaaagugucucuacaaagaaaagaauauaaggucauauuccuuggaauaauuacaaaaucuugauuaaauuuauaugucuccuuuucuacugauuuacaacauauuaacaaugaccuagaaaauauuaucaaaaaccacuuaaugaguugauagaauccaccuuugugguagaggggccugagugauauaaggaaaacaaacauucaacauaagugaugguagagacuuuuauuuccaucaagccacacaaugaacagcucucacaugccuaaacaauaauacaggguaggauuagccagccacauuuuaaguagaaaaaccucuacgguuucuguuuuuauauuuauuugguuaacaauuacauauaaauucuuacuuuaaguaauuuuuauucaauaauuaagugguuacagaaaagagcauuucagugagagcccuauugcugguaucaauauaaaaggcauaaucucggacaggaaucuuugggcaauagacuaaacuuaaauuacacacauacauacacacacauauauaaauugacauguugugccaugaguguacaugaauugucuuugcuaauuuugauguuaaugcuuuagucuuuuaguugauuacuuaagaugucauuuuuuggauuucuuugcuguauaggucagcacgagggaccauugcccaggcagcaugcuggauuauugccagaaucucuuauuugggcauauauuguccaacuaaguucugcauugcguaccauucauacagcagguuuggcaugucgaguuauggauccaacaaagauucugauaacuggcaaaacaagguacuagcauuuugaguuuugguuucuuuuauugagcgucuuaccuuugacagcuuaguaaacaaaacaugauuguuuuaauucugccuuuucauauauuccauccagaagaacuucuguaacuuugaauucauuuguaagcuuuuuaaagaaaaaaaaaaaguugaacucugaauaaaaugccugguuauuaaccaaaaaucuugggaaagguuagggaaguauaugugguuaggguuaggggaauauaaaaauaauaucaauacaacuuuucuauguagcaccaugguucacaaauucuagcaugaaucagaaucaccuggaggacuuacaaaacacagcuugcugggcccuacccccagagauuuucauucauaagucugcauuggggccuaaguauuugcauauuuaacaaguuucuagguguugccauugcugcuguugagucacaugcuuugagaacaacugguacaguuaucagucuugucuucaccugaguuuugaguugcuguaauuuugugauugucuugggcugcauaacauaaagagcugaagaucugguaccaaguuauuuaaguucauauccuggcuuugauaguuuacugucgauaugccguugaacaaguuacuucuucaaauuguguuuugacaaccuuauuagacaaguguacuacuaacuccauucugcuuauuuaugagguaccccucauaaaguuauugagggauuugaaugagucauguaaaaugcuuagaacagugucugguacaucuuuugcaaguguuagaaagcuaacuaguucucuuuuaugaaugacuaauaaacagcuuggaauggugaaaaggacacugaccuguuagucaagagaugugaguuauaguucuggcuuucucaguuucugacuuuuacagcuguagguauaucacuugauaucucugagccuuaauuuuaccauuucuaaaauggugguugguggagguggugugggguaggauggaaguuaaacucaauucugagauccuuccuaauauuuugggaaauguuacuuuuccaugaguaugcaauuuuuuaaaaacuuauuuuaauuauuuucuuuaaauuaucugguccuuaaagguugcgaguaaauuguguuggaguuuuugauguuuuaacauuugauaacagucaaaauaauaauccauuggcauuaauggcccaguaccaggugaguaagaauuaacauggauauuuacuuguuuuccuuuauuaaagacaaauuuuguucauuuuaaaguauuucaguguuuuaagccuagauuuuaauuuauuuugggguggugucuaugcagacuuugaacauguaucucccccuccccucccucucuuuucuuccuuuccuuuccccucucuauuucuuucucucucuuuuccuuucuauucuuuugcuucugucuugcucugucaccugggcuagagugcaguggugcugucagcucacugcagcuuuugaacugggcccaagcaaucgucucgccucagccucccauguagcugggacuacagaugugcacuacugugucuggcuaaaauuuuuuuuauuuuuauuuuuuguagagauagaggcucacgauguugcccaggcuguauuucuuaaccauuaugauguacuuaguguagagcccuuguggguuggaauaaagagaauucaugacaaugucagagacucuuuuuuuuuuuuuugaggcagaguuucacucuuguugcccagacuggagugcaauggcgcgaucucaacucaccacaaccucugccucccagguucaagcgauucuccugccucagccucccgaguagcugggauuacaggcaugcaccaccaugccuggcugauuuuguauuuuuaguaaagacaggguuucuccauguuggucaggcuggucuugaacuccugaccucaggugauccgccugccucggccucccaaagugcugggauuacaggcaugagccacugugcccggccuccugauaacgucagagacucuuaacuguucaaaaugaaaauguauuuaugugauuuaggaaacguguccuaagcauagauagauuaaaacaagacuaaucagaugaauggauuauauuaaaugacacccuucuuuuucacuccuuuaauuacaccuauuauuuuuacuuuuagaacacuugucugacuaccagucaugaaauuuuagaaauguuuucauagguuuguuauuggauugccauuuucuaaguaauuuuuuuauuuagucagaacauaccacucacuucuuauacuuuauuaguauuugauuauugucugacuucauuuuauuaguguugauuuaggccucgugaugcuucuuagcuauuuugcuguuucuuauuuccugauuuaaaugauaaaguaucgaagaauaagaacguaucuucaagcauuaagaacaguugcuuuaggccaggugugguggcucacaccuguaaucccagcacuuugagaggcugaggugggcagaucacuugagcucaggagcuggagaccagccuggccaacauggugaaaccccaccucuccuaaaaauacaaagauuagccaggugugguggcacacaccuguaguccagcuacucaggaggcuaaggcaggagaaucgcuugaaccugggaggcggagguugcagugagcugagaucgcaccacugcacuccugccuggguaacagagcuagacuccaucucaaaaaaaaaaaagagaauaguuguuuuugccuugauuacucugcaaguaacaaaacuaaaguaaauaggucauucaguuuguauuggaaugcuucacauuaggauaggcagcuaugauuuuaagacaauuuuaguucuuuguguauaagaaguuuuuggguuuuuugaacauuuauuaacuuacaaagguuugcucuaaggcagaauuucuuaauuacauggagaaacaccuuauucuucucuuuucaacuuauuuuguuuaaaguuuuggaagaagauuuuaguucacugauagaauuucagaacaaaaagagaacaaaaaggauaaaaugagaaguagagucuaaucaguguuuaguauuucaguucaugcauaaaucuguuuugcucguaaaccacagagaauacagucccaaagacuugcaggcacucauugcauucaguuguuugcagacguuucacacccuucuuucccucugcuugugcccaccuaaccucagcagcagccaagcuguucugguugauagcaacaucuagugggcaacacagggaggaauaugauuaguucuguuuuucccccagcagcaucauucuguucuucugccugagggcauuugcccccucuuucuuaucuggagacauuguuucuuagcuacuuucauucuuaucuucucucuuauacuuagugccuagguaguuggcuccgauuaauuuuucuuuaugaccuuuaugcuuccaaaagugacagauuauugacuguuaaaauauuagugaauauauacacuuggauauacauccaagcagauaauauuaaauuuuugaaggaaaauuacacauuuuuagagccaguaccaucaucuucuaauguaaguaucuagaaacccgugucugcauuaaaaaaaaaaaaaacugcacacgcuccucauucuuuucucaguaggguuccuuuucaaguauguuaugagucguguaguuaccuugaaaaacaaaacuuuucauaagaaaaaaaucccugaguucagacaaccaacuuuaagcauuuagggcaccuuauuaauauuuguaagucaggauaugccuucauucauaaaaucaggcaaccuucaauuaauuaucaccuguuuauuuuuuucagcauuaaaggauauauaucaggcuuucuuuuuuuggguauauauguguagcugauuuuuuauauugcuuauuauaguaagguauaggaaagaauuaaagauagucccaaagggggagugugauuuuacagagaagaggauacaugaggagugcauuguuucuuguagucuauuuuucauaguuuguuucagacacgugaauagagacugacuuugaguaaaauggacauaaguagagccauagauagaaucagaaaaagaaaucaagaagucaagaaucaggaagaaacugaaaaucaguuggggggcaaaucuccugaauucaacaaauggggggaaaccagauggagguaagaagcaaaauaacaaauggaaaauuauuuagcugagaaauaaggaaaggagaguuacuggguuuuacggugugaaacucucuuaagauuuuauuaacuucuuuuguuuaaaaaaacaacucuaauuuaaucuggacugugucauacauguacuuuauuucaaaaaguggauguucuuaccuugaguccgcuuuagagaggugaugggauguacuaaaaaucagauguuauuuuuuaaacccaucugguucuucagcucucuuggaccauuuugguuuucugucucauaauagagaauaauggaauauucugggagggaggcuuaauacagcaucaguucaggguggaaccaaacugaaaauucugcugcuugaagaguuggaagacuguguguugguaccugcugcucaaacacgugauaaauaacaacaaucuuugguaugcuuugcuggauacuuuggauugaaucgcccauagaaauuuauaguuggcauuuauaugcacugauuucuuuuggcugagauuucuguaauuucaugaauauaacuuggaauguuuuacuugaucuaaagugugauugagaggaauucuuuuuggaguucaucacaguguccuccagcaaacagaaaugauggcaacaguaauaguucuccuucccaugccagcuucccuccugccauucugggcuccugacucuaucaccagugaaguuuuaaaaguuuucugggaugaaucuuugaaucuuuucuaauagauucaaaguaguuugucuaccuaaucagucugucuccuuaucucauguucagugucagauucacaaaugcuaguuuuggauaaauuuuuuaguaugaacuuuuaaauguuauuuuaguaauggaguuuaacgucuuuuuacucauuauuuggguaggcuguuguuaaguauaaccauauaaugcuagaauuucacuaaugauugccuuaaaguuacaaauauuccaacaaaccagugguucucaauccuggcugcauauuaccaucauuuguggaagcuuagaaaaauaccaauaccuagauuuuuaucccagacuaauuauaccaaaauugggacgaggggauggcuacugcugauuuugguuuuguuuuuaagcuucucaagugaugguaauauacagcuaugcuugaaaauuccuuauaauaaacgaauguucaguaaaugaacgugugucuaauaauuuagaugaguucucagauuuuaaagaucugcaaaugucuguuguagaaauugcuucaggugguuucauguuaacucugaaguacuccauucuugaaggcaugugguuguuaauagcuuccuaccaaucagggccacuugggaugaccauacuguuuccuggaguuauaauaggugauaaaggacuuaauucagccagcugucuuuugaaaauccuuuuagaaggaaagccucagaaugguaaaucuugagugggagagguuuuaggaaagcagguggugguuccagagcucaaagaucuguuagagugugaggaaaaauagucuauuuggaaacaaagauagaugggaugucauucauugagguuugcagcauuuuugauguucuagagaauuugcucuaaaaucugguuaaugcuaauguuuguaauaggauaacuuuucuucagauaauccuucacauucccacuauauucugggaguuacagaaaaugagcaaaguauguauguuaaguuauaguggucauagcaaagcaaauguauaguaaccuuaaauuuguuguaauagagaagaauauuaccucuauuuaaauaagaaaaaauuagaaaaacuuuuuaaaaguggcaauuuguaguuggcaugggaauugcuuaaagucucuuaaggcguggaccuagaacuaccuucaucagaauuaccugggugcuuuaaaaauguugagccauuuucuggacccacccaaugagaaucucugguagagaggcucgaagucgucuuuuuaauaagcuccagguuauucugagaaucaccaguauuugaggacccugccugcagcuuauuuauaaugaugcuuuuuccauuuaggcaguagugucaguguauuaaaugaguaccugugaaaugaaaauuaaaaguuauauuuauucuuucaugucagcaagcagaucugauaucauuaggaaaaguuguguuggcuuuggcuugcaacucuuuggcaggaauucagcgagagaauuuacagaaagccauggaacuggugacaaucaacuauuccucugaccugaagaaucugauuuuguaaguuuuaauauaugauaaauuguacagaaugauuauuugcgauaagacagagcuuuuuuuguuuuaagugauuguuuugguucccacuauuuaaaaucaagcaaaacagaaacuuuaugucuuuauuuuuauugcaaaguaaauauuucuuagauaaauugauaaaccaguguguuuaaauuaguuauugauguuuuaaacauuugguuaaagggcacccaguagaaguuuguugguauccacuagcuacaugugaccuuuuacauugauauuaauugaaauuuaaagcuuacuucuucaauuacacuagucacauuucaagagcucagcagccacauguaauuacuggcuaauauaauuggacagcacagacauagaauauuucccucaucuuggaguucuguuggauagugcugcucuagagagugugaaagccaucaugaguaagccucaggugcaauccagucauguacucuggccaaaauacccauucuggaaagcauuuguguggagacccccaugcuuacacuccaguaucuuaacgcuccagagaauccuugaguaucgauuugagaugaauuuggcuuaagagaaacccauuguguggacuacugucacaacagaaggacuucuccguaagauauagcuacuauugggagaucccagagggugggcaaccacgaccuuuauuacaguuaugagcuauauuagagaagaggugcuaaucaacagucucuuuuagcuuacagcugcccauucugaucuuucuguguagcccuggaugauccaguuucuuuuuggaccagcccugggguaugaauugggggauggagggugggauugcccaccuguucuuuguuacacuggcauaaauguccuacuugugacagcacuagaagccagugguugucuggauccuauucauaaucaaauucaaauaagaugauuuaucuucugaauaaaaauacuuguuuuauauaugaucacaacagugauuccuagccuuaguuugcaaauaccuaggaugccucaaauaauuucagguuauaaucucuaaauuuuccuuuuuaaaaaaguggggauagaggacaaaaauaaucagccauauguuaauaauuauugaaacugggugaugauacauggggauucauuauauuacuauucuauuauaaauguuugaaauuuucuuuauuaaaaaaaugaauaaacaaaaaagccauacuuuaauaauaaacacaaacuaaaguuuauggaguaauuaaaccauguaucgggcccuuucaaacugcuugaugugaauuaauuuuuuuaauucucccaauaacucuauaaauuagauaccauuauuagucccauuuuagaguuacaaaacugagccacagagauaaaauaacuugccaaagucacauagccuguaauaacauuaaauaugauuagcaggguacacauauguccauacuuacggaugaauugcuaagauauaguuuauucacauggguauagcuauucauuuauccacaaaaaugaugacuacuauaugccaaaugcaggauacuuugaaugaggugaacaaaauucccaucuucuggagcuuacacccuaaugggaagaaagaguaaauaaacauaaaaaccagugagauauuuucagguagugauaagaccuaugaagaaaauaagagaauuacaagcagaagagugaaggagugaguaggaggcugcuuucaugagaaagggcagagaauggcuuuacguauagaauaagcggcaguagaugauugagaaucuuuguguucuaacagguagcccuugaaauguguaguauuuucugccacuguucuaaugauagaagaaauuuaacugguuccuucugcugcguguuacugcauuucucagaaaugaauaugucaugauaccuuguaaauuaaguuuuagagcagaggacagcuucuuaaaaaggcucauucaguuuagcaaaauugaaaacccaguuuuaguucugaaaauuaaucuuugcaaaacaacaggaaaagcuccccaccccacaccuacccccuuuuaguccucucaaaaaaguuucuaaaaaccuuuucuuuuuuggccgggugcaguggcucacaccuguaaucccagugcuuugggaggccaaggcagguggaucacaaggucaagagauugagaccauccuggccaacauggugaaacccugucucuauuaaaaauagaaaaaaauuaucugggcuugguggcgcacgccuguagucccaguuauucacgaggcuaaggcaggagaauugcuugaacccaggaggcagagguugcagugagccgagaucacgccacugcacuccagccuggcaauagaacgagacucugucaccaaaaaaaaaaauucuuucuauuaauuuauuuuuguuuuuuguuuguuuccuuuuuuuugagauggaguuucacuuuguugcccaggcuggagugcaguggugccaucucagcucacugcagccucugucuccuggguucaagcuauucuccugccucagccuccugaguagcugggacuacaggugcccgccaccaugcccagcuaauuuuguauuuuuaguagagacgggguuucaccguguuggccaggcuggucuuaaagugauccaccugccucggccucccaaagugcugggauuacaagugugaaccacugcaccuggccuguaacaaucuuuucaucuagcacuauuguaaagaaggguuugagaauggaaauggguaagugcaguccuacuucacuuuucuuucucauuuccauaguagugaaaauguagagaagagacauguuuacuguuucuccauuggcuguuacaguuuuccagaggaaugaaauguaauauuuaagaaugaacuugacuugcaugaauuaaaauguuuucaaaauuuugugugcuaagaugacggcagccaaaacagcuauguuuggguuaucuuguuuuuuaaauugcauguuggacauccaaguaauuccucuuuuaucuuggguagguauuuguugacugaccaaaacaggaugcgaaguguaaaugacaucaugcccaugauuggugcucgauuuuauacucaauuggaugcugcucaaaugagaaaugaugucauagaggaagaccuugcaaagguaaagaguguaaauuuuuuuuuuuuuuuuuuuuuuuugagacagagucuugcuuugucacccaggcuggagugcaguggugcuaucucggcuuacuguaaccucugccuccuggguucaagcgagucuccugccucagccucccaaguagcugggauuacagguguacgccaccacaccccgcuauuuuuguauuguuaguagagacgggguuucaccauguuggccaggcuggucuugagcuccugagcucaagugauccgcccgccucagccucccaaagugcugggauuacaggcgugagccauugcaccuggccaguaaagaguguaauuaaaagaauguacacacaacuugcaucuguguauauaaauagacacaaaauaaucauuguacuaaauauaaugccuuauuugcuaagauuucagauauuuuugucggcacugaauguuugguauuuuaauuucuuauguccucuggacaacacuguucuuuucauucauggcuuugcuacagucaugugacaaaaaucuugguuuuucaugugaguuacuuuuccaauuccuauggacagcuccauaaucuucuugaguaccauuaugaaaugaaauggacauauuguguuuguuuaaaaguauaaccaaaagguggggauguuaggauuuauuguuuaaagguaauauugguacagguuaccaguuuuuguaaauuuuggcuuuuauguucaguuaucuggaacauuaacauuuuucucuuuuuaaaauguuuuauaggagguucaaaauggaagacuguuuaggcuccuagcaaaauugggaacaaucaaugagaggccggaguaaggauuuacaguauuuuacaauauauuuuuaaucgagagcacuauuuugcauaauaagaauaaguaugccuggcuuuauuuggaaaaagagaaaaauucucaugugaagugaccuuaagauuguguuagcuguuaaggugcuauuuuuaacaacagccuagguguggcuguccuuacgaauuuuacacacauguauacacacagaaaauaugguguguuagaaaucucuugugguuugcacaugagggcacauuuuaugacuaauacuaccucuacccuaucuucuuuuugaggaagaaguuucauguaaguuuacccuggucaguuuagagacuugagaaaucucuaauuuuugcaugccucuuaccuucuauuaaagcacacuuuuuuuuuuuuuuuuuuuucuugagacggagucucccucugucgccaggcuggagugcaguggcacaaucucggcugacugcaaccucugccucccagguucaagcgauucuccugcuucagccucccaaguagcugggacuacaggugugcaccaccauacccagcuaauuuuuguauuuuuaguggagauaggguuucaccauguuggccaggguggucuggucuugaacuccugacuucaggugauccaccugccuuggccucccaaagugcugggauuacaggcaugagccaccacgccuggccuaaaguauacuuuuuauagccaucauauaagugacauuggaaaggcauuaccuuuuacacuauuugucacuuaguuccaccucauuuguaaguuaauguuaaccauauauacauaagcagagucgauguuuguacuacauaacugucaaagacagguagaacagaauuugcaauuacuaugacuauauacguaaguuacauuucaggaauguuugauuuguuaauagagauaggugagagauaaauacuauuacuugagggguuguuuuuuuuuuuuaccauggaauucaaguccacuugcuuuucuucaaagucgaaagacucauuuagugucuucccuaauaauuuuucuaagugaagagaacauaacaauauauguuaaaccauuuuuaauaaacuuuuagcuguuucuucuagcauuuaucucuuuacuuuaaaaugucugcuuauaguucuauucuugauucccccaauauauaauucagcuaaugacucauccucuucccuacacacgugcacgcacgugcacacacacaugcacacaugaguugaaucuguauuuaguguuacaaaacaccucucccaugcggucaaaaauagguaaccuaucaguuccuuuuuuucccucccaccuagagaauuggcucuggauccucugcacuuccuguuccuaucugggcugguuaugcuuuaagccugcacgugcuuacacuuuagaacuggaacuucccuucaguauuaucugggaauucucauuaucucucuguguuggauacccuguuuucuugcuuuauuccuugguuuguuuauuuauuuauuuauuuauuuauuuugacuuaauggagcauguccuuguagcuuccugaaaaaggugaguuuuuuuagucuugcaaguuugaaaauggcauuauucuacuuucacacauuauugauacugugaaugcauacuaaauucuagauuguccucagaaaauuuuuccuuuuuuuuuuugagagggaaucucgcucuaucccccaggcuggagugcaauggcgcauucuuggcucucugcaacccucgccucccaggaucaagcgauucuccugccucagcuuccaguguagcugggauuacaggcgcaugccaccaugcccagcuaauuuuuguauuuuugguagagacaggguuucaccauguuguccaagcuggucucgaacuccugaccucaggugauccaccugccucagccuuccaaagugcuaggauuacaggcaugagucacugugcccagccaggaaauuauucuuauuaauuaaauuuuuuaaauagguugucuaugaauaaaguaaaaaguaggaaaaguuugcagugaaaacuguaaaagucucucuuucauaccugacauccccaauaucuauucccaguuucccccaucagucuauauuuuuaguuucuucuguauuauuccagaguuacaaauacaacuauauauucuuauccccucccccuuuaaauauauaaaaauuguaaaccauacacaguauauuuuaucauaacagcguguuuuagaaaucuuucuauuuagauauguuuaguauaugccaagcacuauucaaaauaguuuacaaauaugaccugacuuauuccucauaacaacccuaugauggaguuaccauuguuauuccuauuuaacagaguaauugcagcauagagagguuaaauaacuugaacaaagguugcguaauuaauaaguauaugauccaggacuccagucuagacaguaugguuccagagugugugcuccuaaccacuaugcuaugugucuccucauacuuuaauggccugguaguaguuuauccuauggauguguuauaguuuauuccccaguucccuauaggugggcauuugggcuguuuucaguccuuugcuagggugggcgguacuguagggacuaacuugugcauacuuaaucuuauauauauguaaauauaggccaauugugauugcuaggucaguaggugugccacuauaauuucauagcuauuggagaauaguuuacccauguguguaauucgugagacugccucaccaaaauacuuuuuucaaacucuuagauuuuugucaaccuuguaggugaaaaauugaauuuaaaugcaguuuuauguucuauguacucuuaacaagcauguuugagggucuguuuuaugcuauugauccauucuuauguccuguucaauucauauccuuugcccauuuuuauuuucaauuggauugcuugucuuucuuauugauauauaagagcuaaagagauucacucuuuuugugauuuuuuuuuuuuuuuugacugcucauuccccacccuuggagacauuuguauaugucuguaacugaccaaauuucuucuuugcuucuggauuuugaaucauaguuagaaagccucuuucuacuccaagauuaugaaggaacuauuucaugguuuuuuccagaacauuugugguuucauuucuucauauuaaaaauguuuuaugugguuagaaauuguauaggguguaagguguaaguccaucuccccuuguccccaagacuaccuaguaguccaaaagcuguuuauugaauagucgaacaaucuagcuuuuccccacugguuuuugaagccacaccucuuccauacuauuuuaauucaaucaugaaauugaauuuugaaaucuagcaguauucuuucccaucuccauuucauugggcaccacuuuguuguuuuccuaauacuauuaaauuuucuguacaaauucuagaaucagcuucuuuaguuaaaaaaaaaucaauaaaccugaugguuucuucauagggaagauagcauauuuaucguguuuaaacucugggaacauuugugauuuuagauguugagucaucguaaccaagaucaugguaugucauucuauuuguugaugucuacuuuuguauucuucaguaguauuuaaguuguucuuuauauaguuauagcaauacugaguguauucuuagguauuucaucuuguugcuauuauaagugggaaaauuucccccauucugucuucuuguuacugguauauaugagaauucuugauuucuuuaaauuuuaugcucugguaccuuauuguuugggucguuuucaguaaauucucuuugaguuucccagguguuaucugcaaauaaugauaguuuccuucccaguuucuauacuuuuaauuucucuugagugguuguguuagcggguacuuucaguacauagguaaguacuagugaugauaguucagaauuugaagcauuguuccuuuuaacuuccaggcagauucaaaggcauuuucuuuauaaauccuuuccuuccuccaagcuuuuggguuuuguuuguuuguuuguuuguuuguuuagucacugauguucagaaauucacagugauguuccuugguguagguuuugagucauaaugauggauuaacaggugaaccccuuuaaucuuggaaacuuaacguccuucaguucugggacauggucuucauuguuucuuuaauaacuucuuguccuggaauucucaucgcucagauguuagaccuuugcaauugauuuucaaauauucucuucuauuuucuaucucuaauuuuuuuuguucuacuuucugggcaguuaucucaacugcauuuuucuaaaauuaaaguuuuuuuucuaauucuuugaauuuuuaaauuucugcuaucauauuuuuauuuuccaagaacaauucuguuuucugaauguuugucuuguaccaucuaauucuuguuucucugaggccgucaguuaauagauuuuugcuggugguugguuuuuguuugucuuaguuuuaaguuuuguuccauucccugcaguaucucauaggaaacaagaguuugcuuuauuuuguuuuguuuuguaacaaaagauuucugauacuuagcuguccauuuguauuaaaaauaagguccuaaaaagccaaugggaagccuuugugagggcagggauuauagaauguugaaccuuucucugugauaaagcagugugauguuguuauacaugauuuuuguuuguuuuugauagacugucaaggauuaucauuugucuuggacaggucagcauccccugaaaagaaucuuccaaccucuacugucugugguauaagccugacagccaggguuugggaaccacacagagggaaagcauuuguugaauagggugucauccagcacuccucagcucuucaucuucugguuugcuuggcaucccugaggcucaagcuucucucuuucacccuuuuuagaaaguaaaaccuccagauuuuugccagacagguggcagugggguugagagauggguuaucuguuugcuguuuauagaaccuuuucucaguucuccuguuuucagccucaguccaaacuugcacuuuuaguaguccuuuguggcuucaguuucugagcuacgccaguguggguugcuugauuccugugggcacccucuucccacaucccuuguagaauuaggguucaguuuugucaggucuacuaagucaucccacuuaccuaucugccucugcauuccagauguucaugauuaucucuuguucacuauuguugcuuuuucugaucccuuuguccuuguguuuauacccuuuuuuagguauuuacugucaauuugaugggcuguugaaagggagcagagauaaauggguguuuaaucuucauuuuaauuggaaguccuuggagugaccuuugcaaacauacauauaugauugugcuaaaaccauauggugaacuucuccucugguucuuagaauaaagacccaguuuuaaaacauguccuaagcuguguagucugaucccuaccuacuucucauccuggcgucaaaucugccuuuuauuuaauuuucuuccccccaucccccauucuuuguucuugucuucacucuguuccuuuuccuugcccuuacccucccucuccguguauucugucgucuuuucuucucuuuucucccccaacccauucagacacaugaccuuccuuaaguuucuucaauguccaugcaaauaccgaucucugacgaaggagcauccuucuucugggaagagcagccacuacuuccucuggaaaaccuuccuuaauugcuuuauauacuuauauucacacauaauuuuacauaaauuuaauguuauacauuuucuguaaucauuguuuuuaccuauuuuuucuuaaugggaauuguaucacaguuugaucugggaagcagaacgacuuuaaaugauacagaaaagggauuaucagccaggcgcggcccuagauaaauucaucuucguuuuauaucauauuccuuuuaggagcauuauguaaauaugcaguuacagcuuucuuugauuauuugaauaacgucuguuuccuacuagacuguaaguuccuaaggucacugaaaacucacaguggucaucugguucuucacagcuuguuuucacauggaaugguaggaaaccgauauuuacuuccuuuuuguuuccuaaacauuuuucuauuuuaugcuuauuggugaaguagaagauguaccugaccuuucucuauucuguaaccuacagagugggaggaagagaagagaagauauuuaaagauauuuuuaccuuuuccauuuuaucuaaugguaggggcugaaauaaggagguaauguaaaauaggaaugcauaagggaugauuucccccugacauuugcuaacugaaaacuggaauucauagacuuacuaguucaguuagauuauuuuuuaaaaacacuguaccagacucccucccaauuuuuuguuuauugggaaaaaguaaaacuaguuuggagucuaaaaaauagacauauggccacagaccauacagcaugaguuacugagguaaaauguucauuucccccagguuucagaaggaucccacuuggucagagacuggagaccguuaucuguugaaacucuuuagggaucaucuuuuucaucaggugacagaagcaggugcucccuggauugaccucagucauauaauuucuugucuuaacaagguaauuuguaucuagauuuuuuaagaucauaauucugccuauaauuuguauagaguuguaucuucuacaaauacuaggaaacuuaagaaaucaggauguacucuuaaaguagccuguaagacguuuuauuaauaacauuuucuacaaugggaggauuuuuacaauacuugcaugaauaauuuuuuggggcaguggaggacagagucuugcucuguugcccaggcuggagugcaguggccugauuuuggcucacugcaaccucugccucccggguucaagugauucuccugccugagccucccgaguagcuaggauuacaggcacccaucaccaugcgcagcuaaucuuuaguagcgacaagguuucaccauguuggccaggcuggucucgaacuccucacuucaagugauucgccugccucagccucccaaagugguaggauuauaggcgugagccacugcgccuggccuucaugaauaauuuuagaauguuuuauuguggaucuuuuuauuaugauaaaguaucacaaaaugacugcuucccuccuuuaugcaauguuuuauuuacaugugguuuuguuaugccgcuuaaaacagugaaugguaaaaagcaaaaaaauaauuuuguguuuauuuuuuaaaaauugaaccccuuccgaaucauugugaguuauguuggguguuaucaaaucauuauuaacuauagauuuuuuuuuuuuuuuuuuuugagacggagucucugucacccaggcuggagugcaguggcgccaucuaggcucacugcaagcuccgccucccggguucacgccauucuccugccucagccucccaaguagcugggacuacaggcacccaccaccaugcccggcuaauuuuuuguauuuuuaguagagacaggauuucaccauguuagccaggauggucucgaucuccugaccucgugauccacccgccucagccucccaaagugcugggauuacaggcaugagccaccgcacccggccuaacucuagguuuuauaaucaaguaguaaauaauaaaagcacaauacuagugacaucaguuacuagcagguccagcuguuauaaauggugaauuugaugauuagaugaauuaaguagauaaaaaauagaucauaaauuuauuugagaggugaggugagcuuuuuuuuggaacgggguuuugaucugucacccaggcuauagugcagucgcacuuauggcucacugcagccuugacuccccagggcugcagugguccuccuucccaccucagucuccugaauagcugggaccacaggcacacgccaccacacccagcuaauuuuuguccuuuuggucgauacgggauuucaccauguugcucaggcuggucccaaacuccugagauuaagcaguccacccacccccaaaguguugggauaauagccgugagccaccacgcccagcagcauuauguuuuagaaaagguugggaaaaggcuaggcgcaguagcucgcgccuguaaucccagcacuuugggaggccacggcgggcggaucacgaggucaggagaucgagaccauccuggcuaacacggugaaaccccgucccuacuaaaaaauuaaaaaaguuagccgggcauggugacaggcaccaguagucccagcuacucgggaggcugagacaggagaauggcgugaacccgggaggcggaguuugcagugagccgagauugggccacugcacuccagucuggccgauagagcgagacuccgucucaaaaaaaaaagaaagaaaagauugggaaagacaaaauuuacagagaaaagaaagaagacaguucccuuaugaauuacuuggcauuaugaaguuuagaacuggucuccaggaguaaauguagucucuguauagguuuauguauaaaccaggagcugguaagccauggccugcaggccaaauccguucuauggccuauuuuuuuaaagcgugagagccucgaauaguuuuacauuuuuaaagaguuguaaaauaaacaauaagccaaaccuaaaacauuuaccgucugacccuuuauagaaaacauuuacugacucuuggucuaaacuuuccuaaauuauaaguacuagaggaaaaaauaucuacuguagcacaugauuuagaacuauuaauguacagugugguaaccuuucagggaaaauguuacgguuuguuuuuaagcacuacuuugccuuccuuuaacuuccuuaaaacucuauaaggaguauugucaauaaccuacauuaagacugcacaaaacuggccaggcucggugucucacgccuguaaucccagcacuuugggaggcccaggugcacggaucaccugaggucgggaguuugagaccagccuggccaauguggagaaaccccaucucuacuaaaaauacaaaauuagccgggcguggugguacaugccuguaaucccagcuacuucggaggcugaggcaggagaaucauuugaaccccaggaggcagagguugcagugagccgagauugugccauuguacuccagccugggcaacaagagcaaaacucuguaucaaaaaaagaaaaaagacugcacaagacuauauguaucauugaacuaauucaguaugaguuauauauuuauuuucccuuuauuuauguuaggggaaaaaccuuuucuugagagcaauauguagaaaauaauucugucagauuuuagagcauaguaucagaguaccaguaguuaaaaauacguagaaccagaacaaacauugacaaguagguaauauggaauaagccauggacaguugccuuaagcaaagaucauuuaaugaauauuaggauaauauuaaauucaucaaagaucauuuaaugaauauuaggauaauugaaaauuugaagaaaauucuguuucacaucaugaacuagcuaguaguaaauaauaccccaaaucugaagugugacaauauucuaaguuugaaaagagugugauaaauuaaaagggaaggauggccagauugauuauacaaaauuaagauuuuauauaagcuuauuuugguagaaauaaugacagaaauugucugguaaaugauuugaauguuugagccuucagugaguuguaaacauauuuuaaugaauuauguaucaauuaaugaaauaaaguacauugaaaauaacaaaaauaaagugaaaaccauaacaagacaaguugauagacuaaggaucaguauuuaugcuuuacaaagaccucacuaaaauauuacugccaaauuccauuagggucaugaguaaagaucauauacuagcauuuacacaagcagaaauaccaaaaguaaauguaugaaaaaacuuugauaauaguaguuaaaaucuaaauuuaaauagcaaggugcucauuugcugugggguugcuggaaaaguauuaaaaucuuauaaauuaggcugggcacgguggcucacaccuguaaucccaguacuuugggaggccgaggcggguggaucgccugaggucaggaguucgagaccagccuggccaacauggcgaaaccccgucucuacuuaaaauacaaaauauuagcugggcgugguggcaggugccuauaaucccagcuacucgggagguugaggcaggagaauugcuugaacccgggaggcagagguugcagugagccaagauugcgccauugcacuccacccugggcaacgagcgaaacuccauccccaaaaauuaaauaaauaaaaauaaaaacuuauaaauucauggugucugauuggaaaacaauuugguucuauguacuaagcuauaaaaccacuucuacuuuacuuuuuuguguuuuuuuaaaauuuuuuaaaaaccaauuucuuaauacuuuacauuuuauuauuaauauuuauacuucuaaguauuuuuccuaaggaaaaaguacuucccacagaagaaaaaaauuaaguagaugaguauguucauugcacuguaauuuauuaugccaaaaauggaagauacugggagaaaaauuauggagcaucaacuggguaaacuauaauacaaacaaacguuaagcgugaagggauagaaacauagggcaguguuuguguaaaaaugucugagucgaaaauuaugugcauacugaugaaugauauaaauguacucauggauaucugaaagggaaugugacaaaaaaaauuuagauauuuuauuuauuuuugcugcaaacguagauaaauucuuuucugcauguuaugaauuucauauuuuguguauauauuguuucagcuagaugcuggugugccagaaaaaauaagccugauuuccagagaugagaagaguguacuuguggugaccuacagugacuuaaagcgcugcuuugaaaauacuuuucaagaacugauugcagcugcaaauggucaguuguaguauuugcuaaaaaagcacgcaggacauggcuaaagaccuuaaccaauagcaaauugcacuacagcugaacuuuucaucaucucauucacauuugggaaacgaacaggagaugagcaaagcugcuugcacuucagucagguacacuguuacuugaaaggaagaauguuucacuuacccaagagcuauggcugccauuggaggcuguuaucugugaagaauuuauuuuagauuuaggagcaccaucaggugaaugauguuccugcuuuuguuuuuuccacuuguauaugcacuaauuuuaauuuuuuaaagacuuuuucugaucuuugaacuuuugccacauuguauacuuauaaugggaaacuuugcaaggacauuuuugggaagcaaugcugggcagcguuuuugccauugaggguugcagaauuugcucuuuuugggauggguugcccugaauaacauuacggaccagguaaauaauuucauagaaguucaguauaguacguaauucuuguaagaguaucguaugcaagcucucuguaugccacccacuguuaguucaaauugagauuuuuguuuuguuuuguucuuaagaacauaccaagaaaauaccagugaauuguuggauaugaauucccuguuaguugauuuaaauccuuucugaauaaagaucagauaaacaguaacugaaggagcauguauagcucuuuccuucaaauucaacuagagccuuuuuaaaaagacauuugccugcuagucagauacauuuacauuuaugcaaauuuuuuaaauaggagaaaauuaagaaauuguguuaaaggccuaaaguucaggaguguauuacuuuagguucuuuccaguuugcugguuuuuuuuuuuuuuuuuuuuuuuuuuuuugggcgggggggagguuuaugaaguuuugcucuuugaaccacagcuuuauuaugguccuuuacacuggagacagacacagagacacuguucagaagaugaacuaaacucagcaguggucugguaucaagagcuuucugauguuuuacagccugaauuuggagggauaacgaucugcugugccuuugcagucacugcuuagcccaaaguaauaguacuuuugauaauaacucacucugugcgauauuccugaauaaguccaucucaaaaguuugggauuuuccuccucuuaacuuucuuaauauuuggacaugcaguugucgccaaacuuggguauucauggaauuucuaguaaaugaaauaccuauacuuugauacugaagacugccaaauacauaggaauuuucuuucuuaaaaaacaguaaugaagacuauaucuccuuucccagcacugaauguuuuacuagcacugggugcucaccaugcaacugaagaaaauguggaaacucaaaaggucaggacagacuuccaagcacuugcaacugauguuacugucuucaauuuuaauaauuacacauauuuguauauuucagagaaguuuuuaauauuucucuguccacuuuuuauaagcuuuaaaaugauuuucucugccuugagauuugcaucaagaaaaagcaccucucuucaccugaaagcuuugaagacuagagacacgcuuuacacguuuuaacaaguauauugaguccacguuugguagcaucaguuguugaguuaaaaagaaaauuauugcauuugaucuggauggauuuuaaaagaauauaauguucaauauuaaaaggauaauucacauuugccaccauaauguucuuuuuuauguaaaaagaagaacuuggagacauuaacaugaaaaagucuuuuaucauuagcucauguauuugaggaagagcagcugucuuuuuauauguuuuuugacaaaucauauuguauucuuuuguacaaaaaagaacuacuuguauucuagaagaaauaugaaaugcuuaauuuauaagcgggcuggagauuuuuuccaauauuguuuucuuugaaaaugaaaggggaucaucuauuuuaguuuuggggucugggaacuuuuugaaaauuuaauuuguggaccaauguuuugugaaagcuaaagagggcagggguuaaaauagggcuugaauuucucauucuguauagaccagcaaacuucccugugcaaggcaaguuuacaucacaaauccaagaauguuugcauccuaaaugcuaguuugcuucagccccuaguuaaccucaggacuugguuugcauauaaaagguagacagcugauauguuuucaugaauaaauauugucagccagaaaagguuggugucagguaaugcauauuuuuuuaagcuuuguuuuauauuuauuuuucauuuaguuuuuauugggaaugguuuucaaagaacucucaguucugccuagguguuuuugggggagcccuguuuuccauaguguaauuccauuuaagagguugucuaaaagucuuuuuaauuaauagaaagauuuuaauauccaagaguagucaaauuaaggauauaaacuuuccacaccuuccugucgugacagauaaaagcacagaaaggacaacccuugaaaucauguaacguuggucauuucaauauuuuguaccuguuuuaaauucuguuaguguauuuacuucauuguaaauauuuuugaggguaccuuuguauuuugcuuuugaccuugguucugugauuuggaugucaacaacuucccuaaaaagcaccaguguguuagguucuaaugucaugacccaauuuguguuauucaucuuuaauccuguuuucagucucuauguguacagcaguauuuuuaauaaagaauuacagagauaaauuu

SEQ ID NO: 191580 - RNA, 50951 nt, Homo sapiens
uaucagcuuaaaacaugucucugcauuuuauuuuaagaaaacacaaaccuggucacaaaacaucuucagagaacaggauaagugaagaaacaaacaaaaugcaugggaauagcaaauuuggggccacggucauguucaaggggcggagcugacaugacaucauuuuguucccggaaaagcaagguuaacucaagcugugaagcccagauggccaauagauuuacagccaucuaaagaagagcagaaugcucucaagagcugaauuaugaugacuuguagguauugauuagaugagaacaccaaccccauauucagcagagaguuagggaaugagaaguagaggggagauggugguggagaucgucuuuauguaguuuucaaagucacuuccgaaaaagaagaugagguaauaguugaauaugccagcaacggacaugaggaacaggaagaguaugaugcguuucccaaauauguagccaggggugcuggaagagaaggaaaaagaaaacuguagaugcagugcgaaugacaccaauuucacacacacaaaaauguuaccccuuuuagauauaugggguuuaaauuauagcucccuggacucaacaaugcuccauuuucccauuuacuucauuugaaggguagaagugucucagcuauuacuagucauugaacuuauuucaaacccaagugaagagagccuagaccucaaaacccauuaccacgagggcucugcuguacccgccccucugugcucucaugauuuccuuaacuccagagcuccuugauggccugaagauggcagguucuguugaccauugggcauccucacugagcauuaggaccauuaagacccucucugcagcugcccauaacgacagacacguguguaaugcaggacuguguuagaagugaaguuuaaaugagccgauaaaaccgguggaaucugaaaggugcuucggcaucugagggcucauucuauucuccugaggcugacuggaauaauucauaucuacauucaugagaccugggcacccagcaaugggagacaggcccuugcauuuuugaguggagggagagacuugguuuuuguuguuauuguuguuguuuguuucuuuguuuuugagauagagucucacucuguagcccaagcuggagugcaguggugcaaucucggcucacugcaaccucagucuucugggcuuaagugauucucaugccucagccucccaaguagcugcaacuacaggcgcacgccaccacucccagcuaacuuuuuguauuuuaguagagaugagguuucgucauguuagccaggcuggucuugaacuccugagcucaggcaauccacucaccucggccucccaaagugcugggauuauaggcguaaaccaccaugccuagcggagacauguuuuaauauacucuauccuucucuccaaggcacuaaauccuaaacugcaucccccagugagaugugaccuccuaauggcaugcagaggccacccuguuucugcccucccucugcagagcccuccucugacugccuccauggcuggcccaucugagaggugauaacagguugggaaaguccaaaugacucaggaggauuguuaguaaagauccugggaaggcaucuuuaggcaaucaggaccgcacaacaagaugagccagcucagcccaacagcuaacuucguacugccaagugccguuuccugccauaaucagagagcagcauuuggcauccacagguuuaauauuagaaauuuuaucaauuugaaaggcaccccauaugcugauaauauaacucauaauuuuucuuuuucuuuucuuuuuuuuuuuuugagacugagucaagcucuauugcccagcuggagugcaguggcacgaucucagaucacugcaaccucugccucccggguucaagcgauucuccugccucagccuccugaguagcugggauuacaggcaccugccaccacaccuggcuaauuuuuguauuuuugguagagaugguguuucaccauguuggccaggcuggucucgaacuccugaccucaggugaucugcccaccucggccucccaaagugcugggauuacaggcgugagccaccacgcccagccaacucauaauuuuucuacagcaggagucugaaagucacucagccauuauguaucaagcuccuugcuacucaaaguaugguccguggaccagcagcaucagcccccacacuggaaacuugucagaaaugggaaaucucaggucccucuggaaccuaaugaaucagaaucugcauuuuaacaagcucccugugggacccacucacaucagaaaagcacugcuagcugacaccagcccuguuccuuggccagcuucauucucucccuguuuuccuguucacagucauguucaugagauaagacauccuaacuagcuccuuaagggggaaaauaaacaucccaaaagaggguguugugggcugaauuaggucccuuccaaaauucauauguugaaucuuuacucucaguuccucagaaugggacuguauuuggagacaggguguuuaaagagauaauuaagguaaaaugaacucauauggguggauccucauccaguaugacuggggucuuauaagaaggggagauuuggacacagacaugcucagugaggugaugaugugaagacacagguagaagguggcacucuauaagccaaggagagaggcugcaggagaaaccgacccugcccacacuuugaucuuggacuucuagccucuaggacugugagagaauaaauucugugguuugagccccccaggcugcagugcuuuguuauggcagcgccagcagaugaguacagaguccccugcuagugcugguaagggaauugaaaauaaaauaaagaaguccaaguaagggauauuuuuuagccagagaauagaggguucagauaaauuaaauugugaaaagucaaauaucgugguggcucagauuuaucacacgaaugaggccaccauaugcucauuacagaaacaagaaaaagugauuugcgaagcuguuuuacacucaagauaaaaccgaagugaaaaaugaaauggcagcgccuccugaugaaauagugaugcucuucaauucagguaggauuuuuuccaaggucucagggcauguggcccucgcagcauaggacuagggugcuuuaacucuucccaggcugugcacaggguguggaagauaagagcucagccuccugcucccuugucugcagggcucagggaaugugaccccaggccgggcacaucauuagcugcaccuuuaagucucugaaguuuggaaauggggccacagcuguggcaagugagcauggugggcagauaccgaaccugacccaggcucagcaaagcugcggagaaccugaaaugcugugagcagggaaggaagaccuugggggccuagacagcgcacaccagggucauuagcccuugaacaaggaggacaucucuuucauguuucuauuuuuuuuuuauaccaaccacagaagacucacuaaucuuucauuguuucuaaaaguugguacauaauccuaaaugagugaggaaggucagaauuaaauuauuaagcaucuuucggggccagguauuguacacccaugacuuccuuuaauucucacagccauccuaugggggcguauuguaaaccuauuuuccaucuaggcaaacagaaaagagagguugcaugauuugccucaggucccacagccagcaagaggcaacacaggaguucagaccugccugugugaggccagaaucccgugcuuugcacugcagggcaaaggaugccuucagacuucggagaccaggauuugguuauuaguuuugaaacagcugugcccuccacaggcagcauaaaacuuacaugaaaacacaaaagcauccugcuaaauaauucccaucucaaaggugcuaaccacuucuaggaugaggcgccguagugugggagaugggggcgcccaggcauccagagcccugaguuccacccaggcaucguggguggcucaugccuauaaucccagcacuuugggagacugaggcuggcagauugcuugaguucaggaguucgagaccaccccagcucagcucucuguggccccccgccagucacccccccuccuccacuucccaccccagguucuuaaugugaacaaaauacgagguaggaacagaaaacauuacagucccuucuuguuuuaaaaaucuguucuuuucagaauuuagggaagugucauuuuaagccuggugaccucuaaagaaaauaaaaauuguaagcucugugaggacaagauauuucuccucugcccacccacaaaucuccaauaaauaaggaccucugcaaauauuucugaaaugaaugaaucauuucucagaaaagagaagugaacagccuucagcgauucccaaacuccaguguguguaagaaucaccuaaagaauguguuaucugagaaugcagaaucaucugagaaugcaaauucucaggcuuccucuggcagagauucugauucauaagucugggauggggcccaggaaucuguaucuuuaauaagcaccacagaugauucuaauacuguuguuugguggguuucgcuuuuagaaacagcagccuugauauccaucuaugcuccccggccuuccaaaagaagaauguuucuccucaaacucuggugaaguaacaccauacuccacacuuggaggggcccacagacucuaaaacauugaugcugaggaggagaaaugacaacgaggaaucagucuucuugcuuuuugagaacuaggucuaugauuauuuugguaaguugaauauauuuggucuugcaaugugccccuggcucuaggagacaccuugggucuccuuggggacaaagacuccgucauguucacuguuacuccuucagcaacugaccugguaccuggcacagagcagguagcaaauaucuacugaaucaauguugagugaaugaggagugagugagcaacucaggaggaggaggagugggguaaccugaguucauuggccucaagaguuggcagucauugcccacccaccauugagcugagaacuucauauugccaagaggaucaguaggagccccaacagaggacaggacuccaugggauaggaagagggagcaacccagugccugcuagggaagguagguaauaaaagaccaagagucaguugccaguuggugccaggugccauugaguucaggcccagguaauagcuuaaaugaauggggaagaaaccaagauucaggcugggcaucauggguggcuuaugccuauacucccaguacuuugggaggccggggauggcagauugcuugaguucagcaguucgagaccagccuggccaacauagcuaaacccuaucucuacuaaaaauacaaaaaauuagcugggugugguagugcacaccuguagucucagcuacucaagaggcugagguauaagaaucacuugaaccugggaagagguggagguugcagugagccaagaucaggccacugcacuccaguuugggugacagagcaagacuauguaaggugaggugagaugaggugaugugaagggagggaagggaagggaaggggaaaagagaagagaaaaaagaaaagaagagaaaagaaacgaaaccaagauucauccuucacugcuggguaguaacugcuacaggugaacuaaacaggauagaggaaggggucagagagaguaggaugaagggcugaaaauaagagccagaaacuucuagagggcauuaaaaagggagcugcaaaauccucgcagggcagccugaagccugaaggaagaagcucagacuggggcauucauuauggaaugucuucccuacccacuggaucaaggaugacacugaacuuccuaagcggacagggcuggagcaacuucuggaaaggggcaacggaccaucugggguucaagagagaaauuccgggggaaggaucucaucuagcaauuccuccucgguuggugaggucaagaacuaaagcaggucccaagagcauuaggugucugcagaguccaagugugacauagcccaggaacagaagagaggccuggggaggagaugggcccaacugaagaagaucucagcaaguagcuucuagacggcaggguugaaaaucuccuugcauuuaaccauaaagccccucuggcuugcaucuauaucaggccguauuuuggucuagauuaggcuuagacauuucuucuaguaucuauuacuucuacuuaugacagcugcucagagugguuguguuaagcaguaucuguguuaagaaggauuccgaggccagguuuggucucuggaagaaagagcaccaugauucaucaguaaugccuaccacggccagaggggaggagaagggggucuagaacccgcgcagauggcggguuauggggcuggcaggaucuucuucuuaucaccuaaagagggagaccagggagggacacaagaaggcaggccauuuauauuucaaugagguccgaagaaaucuacuauuuuaaagauuucuuguaaaucaaucuccuauuguuuauuuuugccaccucuguucauucccuaauaggaaucaguuaguaaagccuuuaaaguuaaaaggacauguggguagguggacaaauuuugucauguucugcagauggucucggaauuaaagcagcuguaggaucucaagcaaguggugacagaugaagagaggagcagugacugagccacaucccugggacuuugcaggggguaagauagggcugcauagggagccaggcaaaagagaagacccucuuauuucauugcuagacauuccacccccacucuuaacgagguaaucacaugggaaaaggcaugauagagguuuuccagggcaaaagagaauaaagaauaucauuuagggcaguguugauaagaauaggagagauaauggaauugugguuuuagaggauaaauaagaaugccacuagagaggaaugaagaaagagauggcacagggaaggaucugcugaaagaacagucauucuuuuuccagcugcagcccggcucacggucuaaccccgucaaguccuugagcuucacaggcucucagguuuuccagauauagcgcuuucacccgcugaccucccuaggaugucacugccuuuaucacuacugaaggaugcuaucuaaucauagagcccauuagccacuagagaggggugcuauuguaaaagacagagcggcugugaacacaaggaaggaaaaugguguggaaggcuggggucagcaccuggggcagcagccucacagaacguguuccuggcaccugaaaccauacuagugcauuaggaauugcaaucucuaaggaacugacggcauacucuaacgccgacauuucuucuguaaguauuagcauguauuuuacuaaaaucuagauuuccuaguccagaugucaggaagguacugugcugcuuuggggcuuucugucuggcaacaucuauaaacaaugcaauggugaugcuagucaguuucacagucucgugucugcaucuuuuuuuuuuuuuuuuuuuuuuuuuuugagauggaguuuugcuuuuguugcccaggcuggagugcaguggcgcaaucucggcucacugcaaccucugccuccuggguucaagcgauucuccagccucagccuauggaguagcugggauuacaggcgcccaccaccaugccuggcuaauguuuuguauauuuuuuaguagagacgggguuucaccauguuggccaggcuggucucaaacuccugaccucaggugauccacccaccucagccucccaaagugcugggauuauaggcgugagccgcugcacccugcugucaugucugcaucuuacugcaucuuauuuucccaacauucuuucuucuggucccugaaagauauguuccucaggacaacuuaucacaaggugcaagcuuuaguucucauuucucuagacaaacaaugaaacauuucacucucaggaggccugggaacccagaccuaaaaugucauuccagcgccagacucugcagggcgggagugcaggguguggggcugcaaggcacgugcagcaaacagcacugaagcacccuuugaaagccagcaccaugcggaggaauugcuuaauaagaaaacugggcaaguccccccagcuguauuuucagagccuucaaagcucagggaaagaagaaucagagguccuagucagccuucccccucccacccaaggggaugcuacggagccgugaaucuagucaaauacuguuuugaauugucacucuuccugcucaaaaaucaggaaucgcuccacaguucuuuaguagucccaguuaccuaccucugcguucucucuccuagguaaccgacaaaguacuuuugccucacaaacaaguacaucaguccagcaaacgcagcaggaacuaaguggagaaaugaaaacaccugugucaguuucguagccaccaaaacaugcuguuagcccaauuaggcaaucaacauuggucacaaaaucuagcagaagacacacgcacuucaggaaaagagcccaagggcuagaggaaaccugagaaccuuccuaauacugguaacgaccuuaugccggcaucauggcauuguuuacaacaaacuuguccaacccggagccugcgggucgcacguggcccaggauggcuuugaauacagcccaacacaaauucauaaacuuucuuaaaaauaugagauuuuuuuugcaacguuuuuucuuuagcucaucagcuauugauaggguuaguguauucuauguguggcccaagacaacucuucuuccaguguggcucagggaacccaaaagacuggacacuccugguuuccaagguauuugcauaucuaucaucuaaccugaguccuuucaacauaacuaguacccacauuucuauuuccagauguggaaacguggguucagguggucaaccaggcuugcauaaggcugucagcucguaaaagggggcagaggguagggcuuaaaccccaaacccagcucugaaacugguucucuuaaaaguacacccuucaccccugagccuccccacagcacaauguuuaaccuuucuugaacuaacagcuaccauuuagaagagaaggacauucccucugcauucuagccuuuugggaaggagauucccucugcguucuagccuuuugggaaggagauucccucugcguucuagccuuuugggaaggagauucccucugcauucuagcuuuuugggaaggagauucccucugcauucuagcuuuuugggaaacugccaagagcagcaccccaauaacucuaugaaguccugaaggcuuggagcugggaguuaacuaagcuggaacuaguguuaucuagagcuacagauauaaaagcaauuuaaacacuuccgccauugagggaauacuuuucaccugccgcagugcuccuggcguuuugggaacuugagucuccaauccucccagcucucugguaaggaguguguuacugucaccauuugacagacgaggaaauuuaggcuuaggccacaagagccuaagacagaugaggacaucugucuuuuuccuagaucaucucugagccuggcauagugccuggcacauagggguguucaaaauaauauuugucaaaugaaugaaaauaagucaggccagugaaggcguggaauuugaagccaggucuuucugauuucaaaacuuuaucaccaccaccugcauuaucaauaauaacauuuauugcgcuucagauguuagguggaaucauaugaaaugcuauuuuuguaggucauaaauagccagauauuggcaguuuuacauggcucaaucugauauaugccaagcacugugucaggagcuuuauacauauuauuucacucaccauaggaaugcuacuagcuagaccaugguccuguuuuacaauaaggaaacugaggcuuggaaaagcugaguaacugccuggagucacacaccagcaaugaguguccuuggauuugccuccaaucagccacuccccaaaacccauuucuuuccacaauuccuccugccuuccaaaauacuauuguuauccggcagauaagaaaaucaaagcaaaagagaaacugugaacucuuuuugagacggaguuucacucuuguugcccaggcuggagugcaauggugcuaucuugguucaccgcaaccuccgccucccagguuuaagugauucuccugccucagccucccgaguagcuggcauuacaggcaugcaccaccacgcccagcuaauuuuguauuuuuaguagagacaggguuucuccauguuggucaggcuguugucgaacucccaaccucaagugaccugccugccucggccucccaaagugcugggauuacaggcaugagccacugugccuggcccaugcuauucucuaaaaaucacaaagcugucacaaucacgauuugccuugggcaaaguuuuuccuuauguuauaccaucugaaugauucugcuccaacuuacugguccauuuuucuuucaaugggaacccaauugaacaugagcuaacagagauuauggguggaaaauggccacacucauaccccugugcaaggaaggugagugccuccugcagggaagugggcugcuggcaccaggaggguacaaauccagccccuaaaauucugauguucguucaagccacuuguuccucugggacuugagcuucugcucuauaaagugagggauuugcacuagaauuaucuuuggguuuccuuucugcuaaaaaaaauucuacagucuacuuuauuccuaagaaaugacgauuaucaaccaagguuacugaugcuuuugucugcuggcaaugacaaagcuuguuuugacaggaaauaccuauuuccagggcuacgaaacaccuucaaacucccauuguauuuaucuagcuacagcaaguccgcauucaucuagaucaagcaucaucuaagacauaaaaagaaccauaacuccuaguaagagcauaguuugacuugauuuuucaaguaaugcgagacauguuuccuauuuaacucaggagagaaaauaggaaauaaauggugagcuuacugacagccuucucagcacagaaggagugccacguggugucccuuaagugguuucugcugccgccucaccucugcucucuaucacugaacuugguucucuucccauauggcgcuucccacccuugucauugucuucauucacugacuucugugguccaucuugccagcuggccugugccucaccgccaggugaccucuagaagcuacucuuuauuuaucacuguauaucuaggcacagggcuuggcacagaguagcucuucaauauauauuuauuauguaaaugaauaaaguaagaggaucuuugugaaaaauccagaauuuuaagucaaaagacccaggcacucauucugccuguguucuucaccagcugaguagcuguacccaaguuacuuuaucucccugagucaaaguauccugaaagguaauaagggacauaaaauccacucuaucuacuuuacagagcggggagacaacaauaagucuuaaacaguucaucaugggacugaguguggccuuucugccugugcccuccagggccacagaagcuggccaguucaugccgaucugccaccaggcacagugccaggcguggccccgaaaggggaccaaaaguaugacugauuuccacucaauguuaaaucaacucuggaaguugauuugucuuuccaacuugcucaagucaagccugugggcugcugauaacugugggaaggccggggauguggcauccagcccguggcucaguggaaacaugccugaaggagggccaccacacuggaagcuuauuagcagaagagccaagugacagcggucccaaaauagaucccucaggcacucucauuuauaaugcccuuguaucugaacuaacacugcuuaaggauucugagucacauuuagccuuaaaccacccuugucagcacagcagcucucagccagccaccagggagcaagcauuagcaaugcauuaucacacgcgcucugcacgggugcagagcaugccugaaacacggccucccgagggcucucaccucuccagggcuucacagaugggagccagaggucaggcaaaguccuuucaacaaaaagccugcccuuugaaccuccuugagaugcacuuuauagaaggagaaugaacaaagggaagucugaguuaccuuggcugcaaaguagccccgcagaccagagcacagcgaggaaagugggguacgcaucuacacaguucuggcugcagaauaaacaaacaaggagaaaaacaaucagagaccaaguuagugcaauguggucugaaaauuaccugaaaguugaaguuaauaaucaccaucgugcaugaaacauaaaucccauucguaauuccacuuacaucuacccaauaagauggggcagccagcugccaccugggaaacaaacaaugguauaaagcaaacacauguucauaauccauuaacucuguuccuacggugaugcguaagggagacuugguuucuugauguauuccucuggcaggguuccuguuccuggcggugccccugcgcuucuuggaauugaagagugagcaaugcagacagaggauguggccacacuggcauggggguggucggggagaagagcccaacuaaggaaacuuuucuaucagauccacaaaucagcccaggucugcaagccaggcugagcaaagaagggugaucuucaaauguuaaagacaacaaagucaacucaaaaaagcuggugcucagaaacuuagcuuacuaagagggugaucacuguaugcugggcacaguccucacucccuggagaguucucacucuaccguggauguuuugcacccuuccucucuuuuuaacucaccauauuccugugaguucacaugauaacuguaugaguuuccucuugcugcuguaacaaguggccacaaacugaguggcuuaaaacaacacgccuuguaaucccagcaauuugggaggcugaggcaggcagaucacaaggucaggaguucaagaccagccuggccaacauggugaaacccugucucuacuaaaaacacaaaaaauagccaggugugguggcaagcaccuguaaucccagcuacucaggaggcugaggcaggagaaucacuugaaccugggaggcggagguugcagcgagccaagaucacaccacugcacuccagcccaggcaacagagcaagacucugucucaaaaaaacaaaaaacacccuuuuacuaugguucaggaugucagaaauccaaaauaaaucucaaagggcuauaaagucaagauauuagcagggcugcaauccuucuggaacuucuaggggagaaaccauuuccuugccuucuccagcuucuagaggucaccuguauuccuugacucagaaccuccuuccaaccugaaagucagggauggcccaucaaaucuuucuuauuuugaaugacucugacaucuacucuuaugccuccuucuuccacauuaaaaagacccuugugguuacaucagguccuacccagaucauccaggauaaucucuuuauuuuaaggccaacuggcuagcugccugaauuuccccuugccauguaacauaacauauucacagguuccuaggauuaggaugugggcaugauuggugagggggccauuauucugccuaucacaauugcucucauguuuccaauaaggaacucaggcuuggagaagcugaauaacuugcucagggucauccagcuagggaguggcaaagccgggauucacaccauaaucagucugucuccaaagccaugucuguuaacucuucaacuauacuaaauuaaaucauagguguccuccugagaagucugcaguccagaucaggacaauaaauaugcccauccaugaaaaacaguguaacuagacuugagaggcauaaaaagggagggaaauaaauacagaggaaaggucacuugacuaggauuaaagucuccauccugacuuuaaccagcuguucaccauuggcaaaacaaucucucuggauuuaguuuccuuaucuguaaaacugagagacugauuauaauucugagguccaugugaauucucacaguccauggucgaagguggcaguucuccaggcaugcucucgggaccagaggcggcagcagcaucgagaacauguuagaaaugcaaauguucacacccaccucaggccuucagaauuuaaaacucuguguuggggcccagaaaucuguuuuaacaagcccuccaugugaugcugaugccugcugacguuugagaaccacggguuucaugugauuauauagguaaaaacaaagaugcaauuuucaaacugcucaugcaaaccauuagggucucaugccucagugguaccacugagaacuugggaauggccagcccuucaucugugcccugcagagaacccagagagaucagguuaucugcgccucaccaauggaaucuucgugguccucugauggucaaaagauccuuuucuggagaagucuaugaagguaacagaugagaaaccuacccuggaauccaggcacaaccaaaaaccaggaacaggacagaaagagcagaccccugcugaccuugcaaagugcucugaaucccagaauuuccacugaucuaauggacacgguaggagcuccaaagggcaggaggccccuacaaauuuaucacuggggugaagugcuuagugaauaaacagguccccaaguaacaauugcagcagcuacugggcacuggcaucacaucuauucuuauauguuacuagaggcacaaaauugcagccucaggacugagaaaauaugauucauuuuccaguucaagaaacuuagagaaaaaauuccuuuuuugguuauucgaauaacauucugugucugaugggguaaaauaucuggugcucuuauuguuuaaaaacuuauuaguaccaaagauuuccccugcuuccuucucuuucucauguuucgggucuuugguuuguuuuuaaguagcgauuuugucuggguuaugcaaaaggaaaaaaauucuuaauugucuaagggauuugcucauuagaaaugugaacugccuagugauuugacauuggguccguauucaaccauuccugacuauuaguucaagucaccuucguuccuaauaaaacauggucagccuggaguugaaugaaauucucccagcuguaagaaaauggguuccuccuguggauuuccagaauauucucagagccuuguuccuggcucuggcucaagccagucccucucgccauccaggacuucaagugcagcuucuacccaaagcugcaagcuuaugugccccuccuggagaggggguugcugcugggcugaauucaaguggcuuuagccaugacagcugcccaguggcugcucguguagucuuugaaguucacauggucugggcccaaugccauggcugccucuuaugggcuaugugagugugggugcauuuccuagccucaaugagccucaguuugcucaucuacaagagguggauggagacauuaguaauuacuucccuagacuguugugagaaugaaacaaggugaagugccaccuggcucacaguaagcauucaauaagugguggcuaucauuguuccaaugucuuccuucuuaacccccaguggaaaugucuuuccuauugacaaauuauuauuauucuggauuuucuuuugagaaauuuugcgcuauuuuuucugcaaaacagaacugaugaacccauuuugagucucauuccuugaggucuaaauaggagcuacucagcagaucuugcaacaauuugcugugguauguucaacuugaugugcugcacuauucauguuuuuauggagaaaagaauucguugcuauauucccuuucauuuuucuccaccucugggaauaaaacauagaaacucuuuaguguuccguuaauuaguuuggauuaauuuaaaguaaguaaauauaauuaauaacaguuuauuaauaauagugucaauacuaauugacaggaucauuguagaccuaucaccuuuaaauaauuuuacaagucuaugccacuugaaagugagucuaggccaggcaccaguggcucacgucuguaaucugagcacucugggaggccgaggcgggcagaucaccugagguaaggaguuugagaccaggcuggccagcauagugaaacccugucucuacuaaagauacaaaaauuagccggacaugguggugcaugcuguaaucccagcuacucaggaggcugaggcacaaaaauugcuuaagcccggaaggcagagguugcagucagccaagauugcaccacugcacuccagccuggugacagagugaagcuccaucucaaaaaaaaauaaaaauaaaaaacagaaagaaagugagucuagaauggacaccaagagauaagagaugcagggagaagcgacaugagggugguauuccaaaaacauguuuugauacacucugcaaaaagugggcgguaggggugucuguaguuaaauaauacauuccccucuuagaaaaccaagaaucagaauacccuuaaacguccucaaaagucugucuauaaagaacuuguuauccccuguaacaccuguuaaaaguccaugaacuuguaauccauuuagaaaauuacaccucuccagagacccuucuccucucugcaaccugugcuuacuuacacucacaaagaggaaucuuaggucagcuaacaaggauuuuucuccaaaaaccaaacuuugaccaaggcugcucuagccaugcucauuggcugggaauaggacauuaaacuguguuuuauacaugugaacaggccaggcacgguggcucacaccuguaauuccaacacuuugaggggccaaggcggguggauaaccugaggucaggaguucaagaccagccugacauggugaaaccccgucucuacuaaaaauacaaaaauuagucaggcaugggggcaugugccuauaaucccagcuacucaggaggcugaagcaggagaauaacuugaaccugggaggccgagguugcagugagccaagaucgugccacugcacuccagccuaggcaacagagugugacucugucuuucaaaagaaugaauuaauuagaauuaaaauauacacgugaacagaguccagguccaauuccuuuuagcucucaaacccuggcucagcucugcccucaugggagauggguggagggacagcccauuaauuaaggccaagucugagccgaugagccacacuggcuaguguaucuguucagcagcugccccagaaucuugagcuaucuguaucagucagcaguuguguuuuaugcuaaaaauacaugcaucugucuuuuuaauccaccaguaucauuuauccuucaugcuguuuuuccuugauagccauggucccuaaacauuuaugaucccacaccccaugaaccaaaaauuuugagcaugcaaccuuauaacaaguauauuugcauauaaacuauauacacauacuacuguccauguguauauuaaaaaugaggaaagcuucaugucuuacuuuucagauagcaagauuaaaugcauguucuuuucuuccugcagccucaugggucaucuugcaacccuuuucagugcucuuggaugccccuggagaagcugcugcugggacgacuuucuccuagaauaacacacaaccccauucccagugguuuccuggcacaggcaaacagaccagcugccucuggcuuuugccagcauguagcugccugcugcauugaucuuugacccuuuuuacaacccagacaggcacacagauauguugcuggcccagggaggaaguggucuuuguaacagaaccgcagcaguguccagacaguuuuugucuuacagaaaacucuccacccugccugcuuaguuccuaccuuuccauggcuaucucuccccucccucauccuucuccuucccucucauggagguugaguguacagacccauggguuuugagagcugggcugcagcacccacacgguggggaugcccaagcagcaacaaucacuuuccacucuccucuuacgcuuuuuaaucucuggcaccccacaacgacuguggaacuuccaaacgaccuucccaagugacacagcauagccaccaaccaaagggcacuucugcaauuuggaggcuggcaacuagcgagcccaggucuaagcaccauggcuucuuacaaacagagcuguucacucccgggggcacguggcagaaacuacacagccuggccugcuccauuucuucuucauugccagcaaauuggaaacuuaacuucuaaccagauauggugaaauugcaccauaacuucuccaaauugguugagcugaggaguccauaggaacacaaugugaccagugagaaugcagucaccuggcagaaguuuuucuuuccaaacugauauagcauaguaggaaugcuuucuuuggauuucgucuggggagaaguuuugaccuugccucaucaaagacaccuucuuugcaccucuugcauguggauguguccaaggcgggacucuaguaucuuucucugcagauggugcaaagaggcugacagcaagugacauaauuucuguacucuccuccaaaugguuuuaaaaugucuuaaaucacaccuuuaaacaucuuaaauugauucugagaauuaauacauggaagaccuaaauguuaaaauagaaaccucucuauaaucaguuuagcaaaggauuuccuugaggucagacugcuggaauagcccuggacagaagugcuugggagaagggaguggagcccagagcacgugggagcauggagaaagagggagaucuagguggcccacuguagcagcacugugaguacucaggggcugucugaaagggaaaaugcccacagagggcaaggggccaggcaaucaaccugugacuaccguacuaaugcguucgagaguggcccagcgauuucggagcugagggagcaaagcagccaaugaaaaacugcaauggaggagaugcccccuccaauccccucaugccuacaccucacugaaacaauuaaaaauaccuagaugaggagaaggacugaagagagaguauaucagugagugugauauaggccuguucagucgagaucccuugaagccaguuuaauucacaggaaaccaacgguaccccugaaggggacccucccucccauggugccagcagcaagcccagggacuccaacccugcagugugaaucuuuguccugaguuugcaccauucuuggcauucugaauacauuuuucuugggugaccaugacucccccuuuggaaggaucucugggaacaucaaaguugcuccugggauggaacugaaggccagcuccucccuuagcucucuagcaugaggccuuccucugugacaggccccuaguccguaguccauaguccccagcaugccugccacuggcugagccuugaaauacacucugcauaaagaagagaggagcauuugaauaacauucauucggauuugcaucccgaauagauugcacccaucuuuaggagccgcucagguguuuucaaacaaccuuuuuauucaaagaaaagaaugagagagggggaaagcaccugcuaauguccccauucuuucuguucuuguucuaguugcucaaggagcccccguguuagaaaaugcaguggugucaccuccagacuuccacccgcaggggagcaaggggugggugaguugaaggcugucgucagcauguccugccuguggcuucugaaggugacuggugagucauggcugguguucacaguagcaacccuggucuaaccccacaggaaauaggucaacuucucuaaccaaaugacucuuucagaucuuucugaagcugcagagaucacaccucccuccaccaaugugccccauauccccacucccuuuguuuugacacuagcacucacuaagaugauaaaggguguccacaaagccucucuggugaaguccaaccuuccucaccucccuggcgcucagaaacuuggcucagacagacaugugguauuaaggguggucaucacuccuagaaggaggccccccugcccaugcccccacuuauuagcaacaucaggguuaggacucacuuggcaguguagacccgcucaaaggcaaguguuccgguccucuggaagcuccucccauucuggguccugcuuucgugcuccacuuuaugggcaaagaauccugccaagggaaaagguuugcaucugguucauugugggcauguucaggagccuguuacuuccuuguuuuacuagaauguuaaaugccuccuugacuugaccuccaagcaacccuaaauguccuccaucaacugucauuuagcagaaacguacucagcagcugcucucuacugaacacuguguuugguguuagaaacacagucaugagcaaggcacggcccccacuuucuaggaucuuacagucuaaaggaauagacaaacaaggaaagcagacauuccacacagcaaagugagucaugccaagaugagauugaguacauggugcuuucagggucaaaggaggcaacuuaauuccauguugagucacagaaggauuccuugagggaaugacaucuaagauaaaaucugaagaacaaguagaaauuagccaagcagacggagggagaggggccgcucuaagcuaagagaacaaaauaugcaaagguucaggguaaagaacugucugugguucagaauguucagccaaggagggggaauggagggcacuggggagggaaugggauuugguagaaccacagacaaggccaaagagggaggugaugaaucauucuuucaaugacauguaucuaugaccauuugccacaugccagacauuuagcuugcauccaagaacaaaacaaagagccuugguuugaggaacugaugcucuggugaggacagcagaggaggagacagaucauccacauuaagcaaaauacauaaauuaaaaugauauggugugcugagcuaugggcgaaagaagagcaugguaaggggccguuugaggcaugcaagaagguggggucgugagccucaaugagaaagaaauaacugagccaggucuucaagaagaugaccauugagauuugccccuggggccuagcagggugacugugaccuugcugagagccgugugaagaaauucagaacuuaguuccgucugagagcaacaaggaauuacugacagguuuaagcagaggaauguugucaucagaaagccacccugucuuuaguguggcaggaacuuagcagaaucagauccaggauagggggauaagauaggaauugacuggggugguggcggugggggugucagagaugccaaggagacacagucuggaggguuugacuauagauuggaugaugggggguggggggggggcggugaaggucucucugcccccucuccccuucuauuuuauuccuuuacuccuuuuucaagagugaaaaaagggauacaugugauugucagggauccaaccacaggguuccuuuucaucaauuucauauuauccuccucaaaaagacauuaaaggggugcuuuauuguguauaggaauaaaagccuuucauguuuuucuuuucuacacaaauaacacuccuucuguaggaaugugcccacuuugaguguaucuguagggcucucuuacguaaaggaagggcccaccucaucccaggcaauguggugggcacuugccauguauuccgucacagagcuuugcacccacucugugcaauggguaguacuguucccacucuguagguaagaacgcugcaacuuuccagagucaaccugcugcuggggagaggugcagccgggacuucaaacucugcggggcauauggggauguguuucuccucuugcugucaccgugaagcucccugcaggauuucaucagcuccacagguuuuuguuuuuuuuuuuuagauacggagucucacucuguugcccaggcuggagugcaguggcgugaucucggcucacugcaaccuccaccuccaggguucaagcgauucuucugccucagccucccgaguagcugggacuacaggcaugcgucaucacgcccggcuaauuuuuguauuuuuaguagaguugggguuucaccauauuggccaggcuggucucgaacuccugaccucgugauccaccugccucagccucccaaagugcugggauuacaggcgugagccgccaggcccagccagcuccacaggguuuaauacaccuguccauucaaaagaucuguuuuuaccagaguaugacagaaaaugcugaucauuuucuuucuggaacccaagaugguauucccugccucugaacgcauaaucaaccuucuauaucugcggguucugcauuccuggagucaaccaaccacugaccaaaaauauuaaaaaaaaaaaaaaaaaacagaaaaccauuugucuggacugaacauguacagauuuuuuuucuuguuacugucuuuuaacaauacaguauaacaacuguuuacauagcauuuacauucuaucagguauuauaaguaaucuaggccacacacaguggcucaugccuauaaucccaucacuuugggaggcugaagcggguagaucaccugaggucaggaguucaagaccagccaggccaacguggugacaccccaucucuacuaaaaauacaaaaauuagccaguuguugggggguggggguggggaggggccuguaauccuagcuacacaggaggcugagacaggagaauugcuugaacccaggaggcggagguugcagugaacugagauugcaccauugcacuccagccugggugacaagagugaaacuccaucucaaaaagaaaaaaaaaaaaaaaagacaaaacaaguaaucuagagauuaucuagagguuacuuaaaguauauggaggaugugucgagaccauccuggcuaacauggugaaacccugucucuacuaaaaaauacaaaaaaaaaauuagcugggcgugguggcaggcaccuguaggcugaggcaggagaauggcaugaacccgggaggcggagcuugcagugagccaagaucgagccacuguacuccagccagggcgacagagcaagacuccaucucacaaaaaaaaaaaaaaaaaaaaaaaaaaaaaaaaaaaggauauggaggauguguguagguuaaaugcaaauacuaugccauuuuauaucagggacuugagcauccacgaauuuuggcauccgagggaggucauagaacuaaucccccagggauaccgagggaugacuuuauuaaaagucagagguuauuucuacaaccagcagcacgaugugccguacuucucugcaucugccucucuucuuucccuccuugcucagagaaccgagccccuuccuuuucucuaaggcugcauccucuaacugugaucuugacccuguccaugccacugacuucaagucuguauuucauugcuccuucucccacuuccagaaucuuuaauaucauauucucuccuuuucuuuauccuggaaacacgcacagaucuucccuauccuuuaaacaaaacaaaaacaaaccugcuucaguccaacauucaacuaggguuuaccgcuccuuccuucuaagcuaaacuuggaagaguuggcugccuuugucuacuccucaccgcccccucacuccccaaccucuuguaauccuccaguaugcuacagaaacaauacaugcaaagaccauaaacacacuuaucucggcuagcugcuaacaguaagccaaaaccagugugagagagagacaaagacacagauagagagauggcugcaaaccguugugaggcauccgccguacgugggcacugcuagcuacuuuaacuauaucaucuugugcaagaccuucagcaaccacagguggagguuaucaaucacuccacugcucagugaaggaaacggagggccagagaaguuaaauaaguuucucaacaaacauaaagagaucuugagauuuuaguuaaccacagaguuaauaugagucagcaaugacacauaguucucaaaaaaauaacucauacguagauuauucuaacagagucgaugcccggaucucaggaacagcuucccuguacagaagacaccuaucugcauagguguucuuagaaagaacacaggaagaggagaggagacccaguggcaagggacuucagaaacguuaggccgaagagggggauauuacagcugacacuguaaacacagaaagagcaggcacagucuaagugauuuuagggaacagcaccaggacugcuggguaaaacgcauagggcugcagauuucagcucaacauaagaaagaacuucuugagcagggagugcuugaaugaaugaauuggaggcaauaugcauggagcaagugucuacucucuaaagucagaugauuagguuuuaaucccagcuucacgacuccugaccuugggacuuucaaccaaauucuccaugacucacuuugcuuaucuguaaaacaagaauaaauaauaguauguauuucuaggcugguuucaugccuguaaucccagcacuuugggaggucgaggcaggaggaugacuugaggucaggaguuggaggccaaccuggccaacauggugaaacccuguccuuacuaaaaauacaaaaauuagcugggcgugguggcacaugcuuguaguccuagcuacucaggaggcugagacaugagaaucacuugagccugggaggcagagguugcagucagcugagauugcgcuacugcacuccagccugggugacagagugaaacugucucaaaaauaacaauaauaauauauauaucuuuauucacuugcauacacuuauaaagaccugucuuugugccaggcaguguccugggugcaggggaauaaagcagggaacaaaauagguacagugaaggaaaggucagccuacagcggccccuccagucucugcaaaggcaguugcaugagugggugagugcaaggauuaaauggugcaaagauuauaugagauaaaacuaagcacagcaggaagcgccauucuucacacaacgcaagcuuucaauccaugcaacaauaggaaaggcaagcuuggaaguuugugaguuuuccaaacacugcaguguucaggaagaagcagccgguggaggcgguggaggggggugguuggggguuacuguaaggaagauuccugcuuugggggaacuucaugagucuaugauucugcuucuagagccugucaaaucccagguuggauggcaaagucuuccaauacggugcuugugagguuucuugugaguguguguguguguguugggguggaacuaguaacagcagcuccauuucccuccuuagcacuaugcucacaaacccuuaugauugcagggccauaaugucgccaaaacuuggaggaggcugccucucuugggggaaagaggccgcugcuaaugccugccagcucccccuacaaccagagcagauguggaacagccuccugcgggaggacauccuuccucugccaucacuaaguguagcucaggggcacugagccccuccccucagcucacauuucuucccaaucacuuucuccaaauacaguaugugcuucccagguuugcaucaugucuaagcugcugguaccuaggcagaagaaguuggaggcucucugccugcuacucauaagaaaugcgucuguguaauuaaaacuugcccuaagccccaaacuggggagacagauuugagcccaacuccugucuccuugcuggccagccuugcaauaaagccuuucuuuucucaaaagccaaugucauaguauuggccaaugagcccauuugcuauauucucugggaaaccaaguuuugauaguucugguccagguuucuuagaaucauguauuuuaaacucguucuguuuuuccaaaucugcauucugcuggaucaagcuggaaaggguuacaaauuugaagaucuugaugacuaaaacauguuugaaaggcagaggaggacauugcaccaggugggccagcucugcccaaucacagaaaaucaggcucucaaaguauagagagagugcagagcccaacccagucaugggcgcauguggaacuguaccuccuugucuugggacacagacuguguacagugccugguaacaccauggaaaucuuuuuuuaacuaacaggaaauguucagaauggcauuuugggguaugaggaagaagaaaggcaggguuuuugcauauuuuuuugaacucuguaagguaggucuaugguugcaacauugagguuaauuagaauugcaaagagaggcuuggacauacaucuggaucuuugugauugccuaaaaacucacaguuaaaaacaaauaguuguguuaucuccugaguuauuugaauguuuugcccccuccauugagagcuauacgaggggcucuucugugguuucaaagggaccacagaaacucccuuccugaacacaggcaggacaacugugcaaagucacucugaccacaaauugccucagcuggcuccuaaggggcagcugugacaauggagggacagaggcagugaugugcaggccaucacacuccagcccaaaaaauuagcucccagcugguccauucuagugucucuucaaccaggaagcccccagcacacucaucacuuccgggaacucuguuagugaggccccugugcccuguggucuguaaaaagucuagaucuccauauuguggcugucaggacucagacauuuggccaucuuuaaucuuaccucuaccucccacuugucccacagaagaagacuuaauccuaucugucaaaaagaauucgaaaucucaccacucaccucaaucugaacaggguuugcuagaccaugauggcaaaguccaggagaaagcccugggcagagcagggccaguucccuggugcaccuccauuaggagaggugaggagaaccuguccuugaaacagagagcucugaagcuucccacaguucagcucugaauugagagggagcuggagagagugagcucaaacuucguagcuggguucagccccaacugcacaggcagggagggggcacaagguccccuguccaccgaugcuccucaguuuuauugaugggugucaggggagaggccagaggggagauccuuccagagcugaauaagugcuagccaccugcccacccauacagcuaccuuugcagagacugcaggcauugcugcaggcugaccuguccaucacuguagcuguuuuguuuccugcucuauccgccuguacccagaauacuaucugggccagagcagggucucuguacauguaugcggguugaauaauggaauccuugccaauuuacagggccaagggagcccugugugaaaucauaauggcucaagaaaaugguggccuaaauaagccauuuguucccucucugagcuacaacuuuguuguguguaauuuaguauaaaaauguuugggucagaaagccacaaaguguaguucuuguagaaaacauacuuggagugugugaagcugagccuuucuggugcagaggcugagggggaggcuugcucugugcccagaaggcuacaucaccagcaucuguccacacucaagaugggggaaaauagaauaucccaaagugauuaaauacucaaaguuccaaaaacgugacagcaugucaauguucaguaaucaccauaaagcuacagcagcugcccuuaguaauuacucuuuuuuucucuaucuuaauaaauauaaaacacaaagccacuggagauaguuaugaaaguggucugaggcagcccuaacucagaacuuuaggaagacagcucuacacaauucucccuuuuccagaucuagguauccugcuuguuuuuuguuguuguuguuguuuuuaacuaauagcaggaauaauggaaaugcaaacgcugaacaggacaauuuuccucucucucucucucuuucugaaguauacacugcauaugaaaaaugcuuccaaaauuauacgugcuagagaaaaagaagguaucaccaaaaaaaaaaguuucuucaggagaaaaaaagaaaaaaguaauauagaggaaaaauaauaagaugauuuuuucuacgcaccucccaaaaucacuuucuuuuuagacugcagaugacugguaacuucaauugcacugcagauguuagaaaagcccaguaucugaguaaauguguauaucauguucccuuucuagucuucucaccuuccaccccuugccuggccacauuaauuaauaguuaaaaugcugaucauagacacuucggugaggguuuuagcaaaaccuucaaguugcagcccuggcucuaaaaaugggacugguaaucaccacaaaagugaaagacuaagaggaggaaaaccccaaauuuacacagaaauacacacaacccuauacauucaaauaaaaagaagaaaauaaagauaagguaaaaguguuugugcaugcgcacacacagacacaauuguuuaagccugacuuccaaacaaccaucaaagaaaaucuccccuucuguucuucccugagugaagggcuuuccuuaccauucuggaccacgcugaugagggugacgauggccaacaggacaacauugccuacaguuucuugauccauguuugcuucaggcuccccagagaggacugcucugccuccagcugcacaaccugcccuguacaggaaggggaagugagagcuugcacucuuucaucauuacaauuucugaagauccccggcacaauuacacagugccuucuucuuccuuuuuuuuuuuuuuuuuuuuuuuuuaacuaaccaccaaaaugcccuggcugugguucagugugucccaccaggagaagcagggcuuggcagaggagcacgcaaagccagcacacucuccuacauuuccuugucaugggaaacuucccugagagucuccagaaugaauccuggacccaagaccaugaccagcacgagcccagcacaggcaccagagaaucuggaagcugccaucaucucugacuucagcaaagagaaagaagggaaaguaaacccaaaacuuucaggucagacagaguggcauaaaccuguaaccccagcauuuuggguggcugaggugggaagauugcuugggcccaggacuuugaggcuacagugagccaaugauuaugccacugcacuccagccugggcaacagagcaagacugucucacacacacacacacacgcacacacaaauguaaaaugaaacuuuaaaaaaauguauagaacaccaaaagaucugugccccaaauacuguccuucuuuuuuugaauuccaagaaaaaaagugaacacuuaacacacgguaaguagcagccacauaagguuugaaugaaggaaggaauaaauggcaguggggagggacagcugauaucuccauuucuucagagaaaaguaauaaagggaauucauaaauuaaaccaaagaauucaaaccaaaccaaagaauucagguaaaaggcagaaauggaguuacagaugaucccuaagggaaauucccaaagggaacugacuuuucugaggcaaucgcagaaacaccuuccuggaaauucuuuucaacugaauaagaguagaguggcugugcuuucugagaaaguauaagaguggaccugcugggugggugagguggcugccugguauucugcagcucagaucagugugaauggcaaucccucugagguuacauggaaaaugcaaaauaccugcaaucuuugucccagacuuagcuauuuggcauugguuaagaggugcuuuuaucaaaacuucacuuugaaagggaacauggaccacuguaacuaguggcagcagggagggcugcaucucggcacggaagaggucaguguaggggaagauauugcucccucauagguacagugccagaggcccgcuucaaugcccucgguucagcugagagagaaaggcugaugaaggcagcgugcagaguugugugcggggaagccagcagccagggcugucgggcuggucaugacacacuuggguacucccugaguaccuagggcacuuuguagaguauagacuuuauauuagccaaggcucuccagagaaacugaaccaauauauaaauaagucuccucauauauauauauugcagauuuauaauagaaauugguucacaugcucauggacaccaugaaguuucaugguuugccaucugcaagcuggagacucagaaaagcugcugguggagaccagucugcauucaaaggccugagcaucaaggagggcaauggugcaagacccagucugaauccaaaagcuggagaacaaggggcuccaguguccaagggcaggagaagauggagggcaauggugcaagacccagucugaauccaaaagcuggagaacaaggggcuccaguguccaagggcaggagaagauggauggcccagcucaagaagaagagggaauuugcccuucugcccgcuuuuuguucuauucaggcccucaguggauugaugacacccaccauauuggugagggugggaauucuuuacuuaguccgcugauuccagugcugaucucuuucagaaacacccucccuaacacacccagaaaaaaacauuuuaccagcuaccugggcauuuuuuagcucaaucaauuugacauaaaauuaacuaccacagaguuauuacaagauugguuagggcucagcacuugcaagauuuguauauucaccuuagugagauccaauucauaccugcaguuugguaaguuucaggggauguuuagguuuugguagccaaggaguuugaaccccauaaagcguuagcucuucuaacacuuacaucuuagugacaaugcaucagaaaugaaggccaguccucuuacaaaguauuccaguugcaagcaauagaaacuuagcucaaacuaguuuaagcaaaaaggagaauuuauucacucaaagagucuaaaaaucugacagcugaaguugaaaagaacagagaugugguuaggccuuggagcuagagagcuuucucucucucucucucccgcccuuccucucuuuuuuuuuuuuuuuuuugagacggagucuugcucuguugcccaggcuggagugcaguggcgcgaucucagcucacugcaagcucugccucccggguucacgccauucuccugucucagccuccucaguagcugggacuacaggcacccaccaccacgccuggcuaauuuuuuuuauauuuuuuaguagagacggggguuucaccguguuagccgggauggucucgaucuccugaccucgugaucugcccgccucggccucccaaagugcugagauuacaggcgugagccaccgcgcccggcccccucuuuuuucucucucuucugucccuuucucucucucuuucccuucucucuaccucugucucugucuuucuuccaaucucuccucucgcucucucucagcuucucuuagcaugucaaacguauucucucugcagaccuguuuccuggagacaucuucaccaacuguggaguuuuacauuuuacagcuuccaucaccugucaaagacugacuucucucaucuaaacucuuaggacagccucauuggcccaggcugcccggguguccauucuuggagaggucaaccagauggcaggagaaugaagacccugguaguucucacaauuaucauguggcagagggggacugacuaaucccgcaaauaaaaauugggaggagggagugagaaguguauucacucuugcacuugacuguccaauaguuauaauccccagauuaaaauuuccaguuuuuaaagaaguuucucuauccuacacgcuucugucuuuuaaacucaucccaaucugccggcacaugaaaacagcacccacggggaccaacguggucagcccccaccaucacuggaaaccuuccgggcuccguggaacgcagggaccccacaccuucuggggccccacaccuucuggggccccacacaugggagaaaaguccagccauucgcgcuuuagaaggucgaaaggcgccuggcgagaggugccgggcaccccgcucugagcuccuuggagucacccccagccagcgcgcagagcacgugcagaggcccggggauggagggaguccacuucacccgagaagagcguguuaauagccgagacggccauuaaauuacagcgcgcacauuaagauucuggcugcagcugcagaggaacacuuaucagaggugaagccuuuggaaaugccauucaucuuaauagagagcugcugagacagaacaaaaagacaaggggcaccgggagagccggggaggggagcgcagcccgcccugccugcccggauucccgcagaagaccgccuggccgcaguccagagcagcccagaauccggagccgcugagcggcugugucguggggaccuagucuguacugggcauuguacccagagccucacauuugccccucagugcaacccucugagggacaaauuaccccccucccauugcccagaaagugaaacugagguucagagggguuaaaaauguggucaagggccuggcaccguggcucacgccuauagucccagcacuuuggaaggccgaggcuagaggauggcuugaguccaggaguuggagaacagccugggcaacauagcaagacccccaacucuacaaaaguaaauuagcuggacgugguggcacagaccuguagucccagcuacucggggcugaggcaggaggaucgcuugaggcuguagagauggaggcuucagugagcugugaucgcaacacugcauuacagccugggcaagagagggagauccugucuuaaaaaaaaaaaaaaaauguggucaaggcaaagacccacauagcaaggagcagaacaaggguucaagcccaggccggucuggcuuuaaagucuggaguuuuaaucacccuacgugcugcuaccggaaucgucuucagaaccugggcucccugguccuucugcauuuguaccuggcaauccccucacaggcuaaagcacugagcaauggccccucagcccugaagagagauucuuagaaaggaaagaaaggaagacauauacacuucacgggaaauaacauauccccacgacaucugaccguuagcaaagguaacuuuacaagaaauaucccacagcgacagggcugcgagcccaccccucucccacccauccccugcucccagcgcucuccguaauuaugcauaugcugcacugaucugugugugacagguuaguuagacaaauaugcugggaguaggcaagaauaauuagcacauucauuaauuagaguacuguuaguaguuugacugugaaggacaaccauuugucaacagagaucaggacagcuggggccaagcagugacucaggggggcaacaauucagggacgccgaggcucugcccagcugcuguuaaaaauccuaggagcugugcagacacuucgcaucaacaugccuccaucgccauggcaacggggccacuaugcccggcugucagccuacaacauucacauagccuucauccucacuucagggugcacguugccaucucaugacaucucuucccuccacuccccauucaggguugcccucccuguucauuaggacaaggauugacugguggugagggagaaggagcaggagguggggucugugccaggcagggcauagagauacagcccaggucuacaggcuggaauuauggaugguuacacaacaguuccuuuucauuucagucagucuaaagaauauucagaccaauauugagcugaauaguaagugauacgaacagagaccaggcauggucuguuccagaugucacaugccaauggugucugugagaaccaaaucaaccugguuaaaguguuguuucuccuucccuggccacaaucaggugggcuuuccuuccaugaacagcuagcucaugguucugaacagaauugaacuaaauugagaugaauccucaugccauucuauagcugaagaaacaaagauagugaauuugcuguaaccucauaugcuauugauuaaacuucacacaugcucagagugcuuuacagauaugacccucuuucucuagaaucuuaaguuguaagcugaucauaucugcgcuaagcgaacaaauagaagacaaaguccauagccauucacacagacagauagcaggaagccaguguaguauccgcaaaacuucuuccuuuucccaucacaaacucacaccacacaguauauugcuuaugcauuuguacguaaaugaagcaaaugacccaugcauguggaaaacaucacguaguguguuguguaagaaaacaaagguuaaggccgggcacgguggcucaugccuauaaucacaaaacugugggaggccgaggcaggcagaucaccugaggucaggaguucaagacagucuggccaaaauggcaaaacccuaucucuacuaaaaauacaaaaauuagaugggcauaguggugcacgccuacaaucccagccccucgggaggcugaggcaggagaaucacuugaacccaggaggcagagauugcagugagcugggaucacgccacugcacuccagccugggugacagagcgagaccccaucuaaaaaaaaaaaaaaaaaaauacagguuagacauggauuucuuugcuccagacuuagcuuuaucuguuuuguaggcaauccaaggaaaggaggucagucaugggcauggccugccuugggaacauucaguucuaacaggauuaaaauucaugaugcccauauaugcucaguugauuuuugacaaaguaguucaauggggaaaggaaagucuuuuuaacaagggugcuagaacaacuguacauucuuauggaaaagaaaaugaaccuugacccuuccaaaaaaucacacaaauuguaacuagaaaugggucuuaaacauaaacauaaaaacuaaaaauauaaagcuuccaaaagaaaacauaggagaaagucuuugugaccaugaagaaggcaaauuuuuuuuagauaacacaaaaagcaugagccaucuaagaaaaaaaaaaucaauaaauuagacuucaucaaaauguaaaacuuccgcucuucaaauaacaacauauauuuugcuaaagaagauauacauauagccaauaggugcaugaaaagauguuaaacaucauuaaucacuagggaaauacaaauuagaacuacaaugagauaacacaauacaucuauuggaauggucagcaaggguauggagcaacuggaacuaucaaucauugcugguaagaauguaaaaugguaaauguaaaaauggcaacauguugggaagaguuugacaguuucuuuuuuguuuguuuguuuuuuagagaccagcuuucucacucugucacccaggcuagagugcaguggcgugaucauagcucacuauaacuucaaagaucugggcucaggugaaucucccaccucagccuccugaguagcugggacuacagacacacaccaccacacgcugcuaauauuuuuuauuuuguacagacaggguaucacuguuacccaggcuguuugaacuccuggccucaagcaauucccccaaguuggcaguuucuuaaaagcuaaacauacacuuaccauauguccuagaaauuucauucagguauuucaucauuagaaaugaaaauacauauucuguaucagucagggauugaccagagaugcagaaccacuagaagauauuuuauauuuuuaaauauauauacacagacauuuuuaagggauuuauuauagggauuagaccuuaugcaauuauggagguugauuaaacagucugaguguauuuuuguuuucuggaguugccauaacaaaguagcacaaacugaguggcuuaaaacaacagaaguguauuguuuuacaguuuuggggaauaaaaguccaaaaucaaggugucagcagggcuaugcucccuguaaaaucacuaagggaggauuccuucuugcuuuuuccugacuucugguuauaauccuuggcuggcagcugccacugccuccaucagcauaugguguucucccuuggcguuucugucuuccuguggcugucauagaaggacauuaguuguauugaauuaggagcccauccugagccaguaugcccucaucuuaauuaauuauauuugcaaugaugcuauucccagaugagguuacauucugaaguccuggcagguagggccucaaccuaccuuuuggggagauacaauucaacccuuaacagugagguugcuguuucuguggcuggugcugaauccuaaaaucuaaagggcagacugucaggagggaaagaaaggcaugaagugugggaagcaaggacaacccaaaacccgcaagacugagcugacacugaaauuugcaagaaaccacagguugggcuagaacccguaacuaucacucaccaacaugaagccccaacuucaacacuggggcuuucugcaggagaaucugaugcccucaucacggagcagucagagaaaccgaaggaguuuccagcagaagcuggaacagcugugaacucacccacugaccuaagccaaccagaugauggacagauucccaacaaugugagacagagccacaugcccuccccgaccugcuuaguguaaaaagaugcugcuccuucacucccaccuuccucaucucaugugaaaugucuccaguggcccacacuaauccagagguacauaggaaaagugaauuuggggaaacauggcuccagcguaggcccacugacacaauacacaucuaccagggcuuaccugguguuagcuuaacauccauucgcaccucuuaaccaugcuaaaguugccucccaaaaagaccguggugacugugcacaguggcucacaccuguaauccuagcacuuugggaggucaaagcaggugggucacuugaggccaggaguucaagaccagccuggccaacauggagaaacaccuucucuacuaaaaauacaaaaauuaaccuggcgcaccuauaaucccagcuacucuggaggcugaggcuggagaaucacuugaacccgggaggcagagguuguagugagccaagaucgcaccacugcacugcagccugggccacagagugagaccuuggaaaaaaaaaaaaaaggcaaaaucaugcuucugccuaacaaugaaacuuucucucauccaacagaaaaugcacuaacccucuucucuuuauucaucuuugagugauauucauucugcuuguaacuaagucgcauucccuuuuugauaucuugugacuuaauacugagauauaaaguuaacuaccauuaacacauauuauguuguauaguagagaaauuaaguagaggaauaggaaaaaacuggucagcuggguaugguggugcaugccuguagucccagcuacucggaggacuaaaugguagaaucaguugagcccaggaguucaagaccagccugggcaacauggcgagagcucaucucaaaaaauaauaauaaauaaauaaacugguuaauauaugcacaaauacauuuauaucaagauaaagaagacauauucaacacuauuaccuuccucauuucucaaauugguugugugguuuuugacuuacauuuauaacuaccuuccacuacucauucuauauuccccuuggaauuccccauguucaugaauaggaauuccaaggggaacacagauggaauauagauggacauagauggacauagauaaaauauucuccuuggaauaugcccuccucagugaguccaaguuccuugccuggugacucaaaucuucauuccugaagggccuggaccaugaucaguccucuguguacuagguuggugucacuuucuauugacauuaaucacagacacauagaguacauacuccucacccucauugugaaguggcaguccaauuucuccuugguaauuaggaucagucacccuaggugagaaaggaacccccuuccuugcuuguguauucacuggcacgaggagauggcaaacucagcugucaguuuaguggaaccaccauuguauucccugauggaagcauuccccccacaggagcuaagauuucugcaauagcagagcccaaaguuacaggaaugggaaggaaaaauuacuacccgaacaccagggugauagugagaaaagccacucccauuuugaccccaugauucuuggacccaugaauccugacaaugggagaaauagcaucauauauuggucacugacuuaaagcauccugcaggacauaaccccaggccagcaggguguugcuacccagcuggugcuguaacugagccuuuaaaauccauuccacuguucuaaucuggccaccugcuucacugugaggccagugaagcccaugaucagaagcucauaucuguacuuccuuugcuguaagauuacuuccuuggucagaagcaauggugguugaaauuuuauaacaaauaaaauuaagcccauggaugguagguuuggcagagcauuguaguagucagggaaggcacauccauauccagaguaaaugucuauuccagggaagacaaagcacugccccuuccaugauggaaaugguccaauguaaucaaccuuccaccaguugguuuucuagcccagggaauggugccauauuggcguagauuucuaucuuggcaggcugagcacucagcaauggcuggagccaaauuggccuugaugaguggaaauucauguugcuguguccauacauagcccugcccccauggccaugauauauguaagcccacugggcaacaguggcuggggaaagagacuagcugaugcugucagaaugaaucaucuuauucagcugauuuuaaaauccucuucuguuguggcugcucuuugguuaacauucauaugggauacauauucucauguuuuguguguguucagagguauccauaugccucuuccccaggacuccuugucaccaguuuucuaaucaugucucuuggaagucccugaccaucagacuaaacgauuaaccacucucugugauuuuguguagaucuguaacucacggacaucuucucuucuagguaaaaugaacacccacuuguauugcuccaaguucugcucacugaggggguuuuccuuuggcacuguccuucacgggcaccccagaguggagauguagugccucagcuagccacuuuggguaguaccagcacuauaaacuaugcuccaauuuguuuuuuccuccaucaaguggucauaggaaacuccccaugaagccacagaugcagacugaggggaagcagucaacuuggcaacaguacuggccaggccaagcgccuguacuacuugcucuugcaacuuauuugugucugcaggaccuacuugggcccaaucucauauuccauuugaugauggaacacugcugugugcacccaacuuucugccuuggaucaaaugacucuuguucacaauggaaacucaggucaaaagacaacacgguggcccauggugaugcauucuguguuuauuauugauaguagcuagaagauguuucucaaaaggcgaauaguuaucuuuggggaaugacacagcuuugcuccaaaucauuaggugcuaugcugggguucaccuauaaaggcacuccaaaggcuccaaacagccuccuuuuccaucacagccacuuuaagcaccaucaugucaguugugucuuaaggccuaaguggcagaguugugucuuaaggccuaaguugcccagcagccugaacuuguauacagagccuacauucauuguucuggggucucauucaaaacuggcagucuuuuaggauucaaaauaguucaaagcuggaaacaaccaaaugcccaucaggcaguaaauggauaaacaaauugugguauauucuuauaauggaauuauccaguaauaaaaagaacaaacuacugaggcacagaacauagaugaaucucaaaaacauuacacugagcagaagaagacagacacaaaagaguaaaugcuguaugauuccauuuguaugaaacacuagaaaagauaaguacaauuuauagcaacagaaagcagauuggugguugccuggagcuggggcuagggcuggauauugacuggagagggacacgggaacuuuuugggguaauggaaaugucucauaucuuuauuuuuggugaugguuacaugguuguucacauuugucagaacuugucaaucuguacacucaaaaugaguacuuuuaugguauguaacuuauacuucaauaaaauugauuuuaaaagagcauuucaaaaaaauguuuagcugagcacaguggcaugcaccuguagucccagcuacucgggaggcugaguuuggaggaucgcuugagcacaggaguucaaagccagccugggcaacauagcaagacccugucucuaaaaaaauuuaaaaaauuaaaaauguuugauguuuaguuagcucaguaguauuuuucacuuaggaguuaaaaugaguuucauagaaacauaaauaacuuuauuuaauaaggauuuaauaaaggaauuuauauuaaccaaacuauggaauguauggauuagaggauguccuggcuuuguauuucagaaagauuagaaauauugaaugguggaaaacucucacccauucuuuuuacacagacacgcaaugcuuccuuuagagccaagucaaguacacaaauacuuuauuauauaucccuuauuccucuguuugcuuuggccuguauuuucaguaguuaaguaauaggaccauucaucugugacucuaagguaaggugaccagauaucuaugacaaaggagaaaaagcaauacaguggagcaaagauagucuuuucaacaaauggugcuggaacaacuggacauccacaugcaaaaaaaugaaucuagacacagaccuuaugucccucacaaaaaucaucaacacauuagucucucuguauuuucugcuucuuguaucuccuuagcaaugaguuguuggauuugaaauaaaauaugaucuuauaggauuuucaacauggcaacuauuuuuaaauauguauggugagaagaguuccaaguaauuuguuacaggagugauccaggguuuuacacugaccuacuaaaggaaccauagcauuagaaacugucuuaguccauuuguguugcuauaaaggaauaccugagacuggauaauuauaaagaaaagaaguugauuuggcucaugguucugcaggcuguacaagaagcauggaaccaacaucugcuucuggugaggccucagaaaucuuccacuuauggcaaaaggagaaggggaggugaagagcuuguagagauuacaaggugagagagaggaagcaagagugagagagggguggaaggauccaagcucuuuuaacaaucaguucuugcaggaaccacuagaauaaaaacucacucguuacugugagaacggcaccaagccauuuaucacuaugaccaaaacaccuccuacuaggcccugccuccaauauuagggauaaaaugucaacaugagauuuguagggaacaaauauucaaacuauaucagauacaguuuuaugggcccagauccuaaagaggaucagaugacaucugggcaggaggacuguuauauauauccucuauguucuuucauugccucacucauucaacaaauacuuacugagcauauauaccaugugucaugcauuggcuugguaccaagcaauagacccaguuaguguuaauaucaguuaggauuaaguucuuuugcauauaaacaaaaaaaaauaaaauagcaauggcuuaaacacguaagcucucauuugccucucauuaaaggaauuccagggguaggcaaggcagugcuggugugguucaaggugaacaagaacauaggugccuucuuucuuccuguucuacccaucauaaagcugguuucugccuuaacaucaccugauugccugagacagcuuugaagugucugccaucugcaccgcauuuuaggaagcaggaaagagaaagaguaagaagugaaaugaggaauuaugucuucaacgagcuuucuuggaaaucccacccuucaacuucgacuucuaucuuauuggccagaaugcuguugcauggccauugcuagcuucagaaaagaugaggaaugcaaucugucagccgggcacuuuacugccuugaauagagcuuggaaugaaugggaaacauuuuggguagucaacuaucucaaucuuuuuuuauagaggaugucaggaaaaucuuaccagaggaaguguugucuuggcaaauacaaaaggaaagaagaaacaguauguucaaagauccugagcaagagaaagucaccauaaaguugaggaccugaaaaaauuuccauuuagugggaaaucugauugaaaagaugaugugggagggguuggggaaccacaucccaaagggccaugccucuuccauuaaggaguuucaaaaugauccugggggcaaagagaagccacuugaggauuuuaagaggaggagucucacaaauggauuugcauuguagagcacucuggcugcaguguggagcauggauugagagaccagcacagagacagggagagcagcuggggucuguuccagagaagagaugguggauuagacuagggugguggccauggccuuagacagaaguuugugcauugagggucuguuuacuaaauaguagcacaaggcuuagugagggguuggggguaaggaagaggagucaagaaugguacucagauuucucacuuaaaaaaacagauaaaugucggggccacugccugagaagucccucucaagacccuuuagcuauccucagucuuacaguacuugguuggggccauuugggaacguugcugaaguucuccuugcuuggcuaauuuuggcuauucuugaguaaauguuugauaagcaccauagcccccaaacaacccauuugacaguuggauugagacauggcaaaauuagacuugaugcagauguauguguauuaaaaaugaaugcccuucuccuauggccuccugauaaagaagagagaaguguguucggcuagcagagagaagaagcguggggugggaucaacgaagaguccaugaacccugugcaauggcuggagaacugaaugacaagcuccauuucccccauguguguggcugugggguccccagauauagguuagggaugcaguaaccacaccucaucuugggacugaauuacaacucuuucaaccaaagagcauuugugcccacagagaagugggaaggaaaauuagaaaagugguuguccccuccauaaaaugcucucaggguacagacaacccauucucuuagggaugagcauggagaagagauuucuuuuucugccuuuuauugacaaaaauuuugcaacaugcaaggaaauaggauauucagauuaaaugacugggcauucaaauauucaaaaguuaaguuccuucccccagcaaaauuagccugaccacauuaacagaguauauauugcaugaaagugguuuaguuccuguuuuccuuuugaauaaacuggcuaaaaauauuacuguuugugguguuaaauggauuucauaacuaacacaggauguggcuaaauucauauuacugugauaauuuuaauugaauuuucugacuccuacauguuugucaacuuuuaacacuguauuaaacauaagguuccaauguuauuaauaugaaaugcucacauucccuuacaacugugauuauauuuuguuaucauuccugaauguuguauuaagucuauuuaaaagauaucccaagagacccuuauauguuuacugcauuagaagaaaaacagauguucucacacauccugagagauaauacaauuuacauugcguaugaagcuuguugagaaccacuuaaagaucuuucuagguagccagaggguuuaaguaauccauagcauccgacagcguaucauauuagaaaauuagaaaaaaaugccaaucacauuuuccaaaugcaaaagcacauuuaaaaauuauccucuagaggccgggcgcgguggcucacgccuguaaucccagcacuuugggaggccgaggugggcggaucaugaggucaagagaucaagaccacccuggccaacaaggggaaaccccgucucuacuaaaaauacgaaaauuaucugggcgugguggcaugugccuguagucccagcuacuugggaggcugaggcaggagaauugcuugaacccaggaggcggagguugcagugagccgagaucacgccacugcacuccagccuagugacagagcaagacuccaucucaaagaaaaaaaaaaauuauccucugggaaaaaaaaaagggaacagagcauuugaacuacaguccuacuguucucaggcugugauugaauuacaaucacgaauuagaacugacaugaguuuuucagcggaauauccugaccagucgccucacucacuuggaacuuguccaucgucucacuucucuagaagaagccaacaaccuaugacauagcaaaagaugacccuggacaaucaaaauagauuaaacagagaauagucacuaaacaguauugacucuuggaaaugcccuaaccaaccugguuauuuuaugaaggauuguaacaagcuuaguucucugaaaucuauaccuagagcagauaauaagcaagaaaguaaggagaaaugaggagaaagauacagaaauauuuguugaaugcagcuaaaugcaagcagccuuacacauauuauuuaaucuuuaugacaucccuuugaagcgguaugauuaucccgguccucagaugagguuacugagacagagagaggucacgcccugugagugcaccaugugcaugcaaugaagcugaaauccuagccuagagagucaucauuacaugaccaacaauuacuaacuuuuauggaauguuuucuagguauaccagauacagcacuuuaugucuauuauaacucuuaauucuuacaaaggacuuuaaaucaaccuccauuauugucaccaugccauagaugagugaauugaggcuuggaaaguguaggucccuuucccuucauugcacaacuagcugacaacugagacaggacucagacccggucagugugaugccugaguucgugggauuucaccacagccugcacugcgcugacaggcacgauggcaacagaaguagcaacuugauggcagaacacaaaaaaauaaagcuagacaggccaagacauccaaaagaugcugcugucacucaagaugaaggcaguaguuuggaucaagggaagacuguaaggcaugugcccacauucucugugaacuugggggagggaguguccaggaguucaguggucagcuaugagcauagcaggagagggcugucaugaccucaaaggucaagguuuuacaggaggccugggagcugcauugggcagcuagggcgacccugaucccggcuacugaugugaccucagcuuccaguguaaaccccauguuuugacacugagcuuuguggaaugaagagaauaaaaggccuuuuuugagaagguggcagggauggcagguuccagagaaaguaauaggugagaggaacuuucagagaagaggcugaagccacacgagaguuugcaguucauggugugagcauuccaaagggcacaguggauggguaugcaauggagaaaaggauggaggaagggggcaagggugggucagagacauggagagaagaacugagcaauaaggcaguguguaguuguggaguuauuauagauaugcauauauauauauauauauauauaugcauaucugugauagguuuucauccacaguuccuggcucauaacucccauagcccuuacuacagucuuguuauaauguugaguguguuagaccucagaggcaggccucaaaaacagaaucuuuuggccagaugcaguggcucacaccugugaucccagcacuuugggaggcugaggcaaguggaucaccugaggucaggaguuugagaccagccugaccaacauggagaaacccugucucuauuaaaaauacaaaauuagccaggcaugguggcacacgccuguaaucccagcuacucgggaggcugaggcaggagaaucgcuuaaaccugggaggcggagguugcagugagcugagauugugccauugcacuccacccugggcaacaagagugaaacuccgucucaaaaaaaaaaagaaaaaauaaacagaauuuuucucaccuacucccccuaccccuuucaccugcccgucaaggcaggacucuaaucuugaccccaccccaccuuucugacugugggucuuaaaacccuccccagagaaggucuugcccuauacucuggggaaagaaugugggugucuugaagcuuccauaaaaacccaagaggacuggguuggggagcugaacauguagaggcugauaggcaggugaaggagaacucauucauguacugagaggguggugcacccccgcuccacauggacagaagcuccugcacuagggaccuuuccacaccucgcccuaugcaucucuuuaucugccuacuuuuauccuuuaaaauguccuucgcaauaaacugguagcuguguuucccugaguucugugagccacucuagcaaaucaaccaaacccaaagagcggagugguuggaaccucaacuugaaguggauuggucagaaguuccaaaggccagcccucugacugggagaaggaggguuuaggcuugaggaucugacacuaucucccaguagacagcaucagaaucaaauuggaggacaccagcuaguguccacugcuugggguuuucccccacaccuuugcucgcagaagucuucugcauugaugauuguuguuaugcugcuguaagugaagaggaaaaacucaauuugggaguuuuuucaaaaacaguaauaaagaauuuaacccugcccaaaaagaggucuggcuucugcccucagcuucugagaggugaucucuaaggcuuuggaacguccugccugcuagagguguuuucauuugcccggggacauugggucauggugugugauuuagagcagggacugugagugauguguagcgguggagagucugggaacagaucggccgcaugggcagucagcugugcucaugugacagagccacaguaaagacccuggacaccaaggcuucccugguggggaacacucccuguguguugucacacaucaaugccaggagaguggcgcuguccgugacuccacgggagaggaccguaggggcuccaugucaggcacuguccuggacucugugcugugugcuucuuccuuuggcugauuuuaaucuguauucccucccuauaagagaucacaaccaugaguauaacaaccuucagugaguucugucagaucucccagcgaauuaucacaacucagggugguuuggggaaccccuugacuuguaguuggugucaaaagucaggauaguguuuuguggacuguguccccucccacuuccaguuggcuaaagguucacaggccaucacugacuauacaagggaggauggcucauugcaggggggcugauauuuuagccaaugacuaaggaacacagagcugcaaagugagguagauugacccccuuagucucuuaaagcaacacuucucaaaagcuaauguucauacaaauaaugucggaaucugauaaaaugcagauucugauucuacagguccaagugcggccugaucuacauuucugauaagcugauacaacagcuccuuggagcacauguugaguaagaagaucuuacaucaaugguuuccaaacuguguuacauguuaaaauccccuugggaguuuuuaauuauccucaugcccaggcuacacaccaucuaaugguaugaggccggugucccuuucccuguuguugcaguguuggcagguagagucaaucaaagcauggagccagguaaagcugugcucaugauugaaaaaugcaagcuaacaauagagguugagagauuguguuuuagaagguugugaaauaagaaaaacaagacugacaaagaagcaaguagcuccacgugggauucuccuuguccuuggggaucucuuccuuagcaugugguggcugucaucgccacucugacacagcccuaguuacucagaucccuugcagcagcucagcucuggaggggagcccgggcucaauggcaggagcaggcaaauguugguccaaacucagcauugcagugacauucuuaucaggccauuaagugcugauauuuuacuauuacuauauauacauauuuccaucacuuugaaugcuggauucgguagcuaggaaaggacagccuuagaggucaaaggccacuugccugaaaauaagguccugaaagaaaaaaaaccagaagcccaaggggaugaucauguguuaugaaaggaaacucuauggagggcuuuucaaaaugccucggcaucugaacauauccucaugggaaagaccgccccaacacgaauguggccuccacaggguuucaagaggagucauggaaaaggcagcuggggccauuuccuggggaaugggugacuucccaccccauaagugaugucccugccuccccaucccacugugggccucagagguucaaacuaccuguugcaucugcaugguguggacauagaggcagccacacugaggagcaagcaagaaagggcaugcggauaaccuugacucccagggccccagaaggcacucaccaccuucacucuggccacugcaauguggcagaacuauacucccaaagccauauuguuuauuagaauaauaagaaaacuaucauacauuaagugcaguaaaugugccaggcacgggaccaagugcuuuguacccaaugucucaucuaacauggacaaaacccaauaagacagguauuauauuauugcccuuuuuacagaggaagugaagcuuggagagccccaggaacuuggccauagucaugugacaaguuaaagcccgguucucaaagccaggcugccaggcuccaaagccagggaaacccaauuguuucugaaugaccaggggacucaagcaaccgguccaaggucacauauugaccuggagaaggagcaaggcagugaaccccagagagaggacaagccuccuauguguuguggugccucaggaccuaucaggaaaugaucuggccagagagaugaccccuuccaagccaagggauagauucucagaaccuugacacagcucuaagcggggaguacaguggguaauaugauaagugccaggaacggaguugcccgcaaaggaaaaugaacacuguggcaagcccuaaguuucccaacaggaaccagaggcuguaagcuaaguaaagucauucaacaagugcccagggugugacggcguaagcuuaggagagacugguagccuucucagaggcuacagaugccccagcagaacgcccaccaauguuucccacaucuaggaucuucuccccuuugaagcauccaagacagccaucagcaggcuggagacuaugcgcuagguccuggcucaagaacuccccaccccccaccccccaccucccaccucccaccuccaccaagcucucuugccagcggccaccucuccugggcaggagccagaggaaugcagggagaacaggaaagaaugaaugaugccccccaaaauggagcaucugcccugggcaaugacgggaucccucugguucucacucaaguggaugaugccccacaucgacccgucaggucucccucuccugauccuucacccucagacugggaaacccucucagugaggacagagauacagcuuuuuccugcccaacugccuuucucaggaaagaguagaaaggaucacccagcuuccaauggaacagagagaugcugucagcuuuuugugaaucucugagcacucagcucaggccuuuuuuuuuuuuuuuuuuugaaaguuagcacauccaucacauccccuaaugccuauucggcaucuguucucuaaagagccagggcuaggaguuaccuccagggguaacuccuguuauuuaaugcaaggcagagaguuccuuuaguguaugcuaggagucugacaccauaauucagauuuauggaauaaaauucuagaagaaauuugguucagaaacagguagaguuugauauagauccuggggccacucuagcugcccaauacugcuucugggagccucgguucuuaaaaaccaccgaacauggcccugggcccaggucaaauuuguaggaggcaugguagaagaugcacacacaugcgcgugugcgcgcacacacacacacaccagcacugauggcuuauguucccaaugugccccaaggugccaaaggauuucccaaauucagaaguuuucagagucuucuguguaugccagggagcaucgugauuaaaugugagcauuuuuguuucuguugacuucuggagccugguucacagugaagucaguucuacagaguucuugcagaauuguccagaugugacaggguccuccucuucaaaaacgggagaugagaggaggugugagggggcaaagguggggugcaggaaucaggccaugcagagcugccccucccuggaguccgggcccuuucaaccccaucuuugccagagcugugaccccuucaccuccaaaugcccagauaauagga

SEQ ID NO: 191581 - RNA, 63331 nt, Homo sapiens
uaucaauccagcaggaugcugaugguuuuauuugauauugaaaaggcaaggaaagaguuguuagauuucuguuauuauggccacacuggaaucagauguugugaguguuucuauuucauggacagugcaacccgaugugaaagaccacacagugccaaccuguggucauuuguugguggguuguguugauuagcuagagaucagcugcaccucagcccacuauacacgaauucacaugugcuuuucaggcauguggggugaggagaggaaccuuuggugcuguccucagcaugguugguagauaguacagcugccauuggaaugcagugacaggagccauucugcugugcucucugugcagaaaggcuugccguugguaaagaugaaaagcauugcagaugucaucuuccaaaagcuguccccuguuuuagguaguccacugaaaguccagugauccaaaaugauugcuaggaaacugguuucauuauacugucuccaaguguuauuuuguucaaaaccccaaguuucagggaagaggaguccucuauccacacaauggauguagauaaacuuuuuuuuuuaauuuugaaaauugauuuccucugauguuugugcagcagcuguuucaacuuguccuuaaaaaaguugguugugagaguauagaggauuggauucaaagcacuguuaacuggaaggaaaaaaaucacuauccaggaagucauugugucuggaaaaggaagcaaagugugaaaaaaaaguugaaguuuuaaauagacauaaaauacaaauaacacuuugcagucaaugcuauuuaugagagggagacauaguacauuuuaaguuuucucucaccugaaggaaaaucuuuguuggaagagcacagaagcuaugaauucaaggucuuaacgauuuaacuuuucugaguuucaguaaauaaugugaaggucauugugauauuaacaggaaauaugugaaaacauuuuguaaacuauaaauugcuauauaaugcauuuuuuccuauuuuaucaccuuccuuuauaggaaaauaaaaaaauaaagaaauaaucuuuagucaauagagugagguucacaaaacuucugguccccuggaccaagccagaucugaccuuggucuuaacuccauccaguucucaaagcuuauugcccugcccugguguucugguuauccuguuauccuauuaaaagcuuugaagagcaaagaggaaugcauucccuaaacuugaugaaauucucuugugugcagcccuacaaaugcuaauagaauauucagggaaagaggucacaagaaguucuuugugaggugaaauuuggaaugauaguguccuuccugagagcaucauuucauuugcuugguuagcacaaaaugcaucuuucccuuuacacguggccugauccuguggccggacacuuagcuagguugagugugagcgaaucacuuaugcuuccucaacuucaucugcucucucuguuaaagggggcuggugauaacuugcucacugaauccagcgggcugggccagagucagcucugcugaugugcuuuuuugguacuaagacuugagauccucaaaccuuaccacaggacgcuacuuccucucacaucuucacaauuucaaggaacuccccauucaggugaagagguggcuaguaagacccaugaugcuuucucucaucauccucugcucuccuccuucgcaaucucauaauuuuuuuuauccuucagccacuguuauuuuguucuucucuugacccugccuuauuucuuguaucuuucuguucuuccucucuaugucuucuuccuuuuccauuucuucucugacugcuuaucugaccuuccuucuucuuuuccuuugaucucuuuccucuccuuuucuauauuuaccuuccucucuuccuauccuaucuucucuuccuuguccuuauuuuuuaacugaaaggaauaugaaagaaaaaaauuauguuuuagccugucuuaaauuaaguuuuauauuauuugucccuaauuuaaaaaaauuagacaaucugaacaguuagugauugaagaaaaacaaaauaaguggccuuuuucuguugugcccacaaagggaauugugaucacgaaucccaccccaaucucacagaaaaacaaugccugauagugccugcuuucaauuaggcaaaggcaaauaggccacguaaguuccacucugaaugaaaucaggcauguucagggugguauggccauagacuuaaguucuacucugaaugagacuucuuuuuguuuuuguuuuguuuuguuuuugaaauggagucucacucugucgcccaggcuggagugcaguggcacgaucucggcucacugcaagcucuaccucuuauguucaugccauucuccugccucagccuccugaguagcugggacuacaggcaccugccaccaugcccggcuaauuuuuuauauauuuucaguagagacgggguuucaccguguuagccaggauggucuugaucuccugaucucgugaucugcccaccucggccucccaaagugcugggaugagacuucuuauaagauuagcagcagcugaguucugagauaggcuaacucuggccuaucuuuugggugaccccagguacugucaguggcaugccauaaccaguaaaugccagacuucuuggaggguggggacaggguugguuuaggucagugaaggcagcauuucuuacaacgccaugggaagcugggcaagcgagaagaagcuuugucaacugugaucaugacauuuuuccugguuccacugagguguucaagacaaaccucagacuauugaacuauacauguaaagaaagacugguguguggcucaauaauguuuccacaagacaauguucuacucuucuaguucccuucauggggguauuuacuaagcuuaucaugaucugaggugucguagacucgcugaggaugaugaguucugcugccaugugaggacacagcagagcggacgccuccugugaggcaaugagaagggcucaggagaaaucaaaccugcugacacuuugaucuuggacuuccagccuccagaacuggacguccuuuguuauagcaguccuaguggccucauacagacagaaaaagccucaaagaagauuaaaacaggcaggaauuugagggaccaucuagagguagucucauugaggugaggugagauggucucccugagaucacucaacaagucaguggcaggggcaggagaggaacccaggaccuccgccuuacuuguugcuggguccuucuuccaccacacuaggcugcgucccccuacaagugggaaagcacaucaaaagguguggagacggggucaggcuuggugguucacgcuuguaaucccagcacuuuaggaggccaaagcagggggcagaucacuuggggucaggaguucgagaccagccuggccaacauggugaaacccugucucuacuaaaaauacaaaaauuaacgaggugugguggugcacuucuguaaucccagcuacucgggaggcugaggcaugagaaucgcuugaaccagggaggcagagguugcagucaguugggaucacaccacugcacuccagccugggcaacagagcgagacuccauuuuuuuuuuuuuugaagaaaguguggagacaguaguggggaggggguugaugagacugauccccuauuccaucacucuuggaccagcucaccuucuuuaguugacuaaucauuuacucaaaagcacuaugugaaaaacacuguggaaaaugcacagaagaauaagacauacacgccuccccaagcuuaucaucugaaggacacaauggacacacuaagaaauagugucgcuaugaggcaguucacaugaggccaauaaaccugguguaaacaaaccaucauggauguuuaagcaacuggauugcaugaaaguggggugagaagagaucgaaaauggcacugcaccauagaagagggaguauuuggguugagccuuggaggaugggaagugguguuuaguacgcuaaaaucuuagaaggugaaaguauaauccagguuggggggacagcuucaggaaaggcuggugucuucucagaaaagcauagaaaacaaagcccaaucauuccagugggccuggaucacaguguacgagggugggagguaagaaauauuauaaugcucaucccagcacuuggacuuuguuccaugagcaauggaggccaacggacacuuuuguccugcugaauuugaaagguuaggguguaaaauugagauguccagguagcaguaauagauuggaggcuguucaucaagugaacaacugugacuauuaacauuuaauuaucucuguucuucacgugcaacugggucuccccacaugaccucccacaaaacccucuuauggcuucuucuuucaccacccagcaaaggcuuccaaguauucagcccugaccugaucuccuuccuaauuuucacuuucguauccuacacggccugaggagcaucugugccauguggagacagaacugauagcuuaagaggauguugugaauguugugugguauuuugcagcaagauauuugacauagccucacaacugagugcacaggagggacauagguuguuacagcuguuuaucgucugugcauucaucacucuuucauaagggcuaucaaaguaucaggcauccugcuugacacugaggagucaagauguauaagacacaauuacugucuuggaucaacucccaaguagaucugcuaucggcuggaacaguagguugacgaugauuccaaacuauuuuacugagaguuagguuaaagcccugggugguggccccuaaauagcugugaucucuagauuccagaaggggcuucagaugaaauucugcuaaggaaaggugauuuucucugguugaaguagagguguguucagggaauuuggccuuuuggaggagacucuuucaggaaauaucucgugcuccgcagagcccagcaugacauuuuauggcuaggaccauggaauagaauggugguucuagccagaugagugugcaucagaaucacaggggaauuuuuacauaacauccaucuauagguuuuagccucuagagacaaaacagucccggguggaaccugggcauguauauuuugauuguuuuaugcauacuccuagugaagaaccaaugucuugcucagauagaagcaagauacucagacuuaguuucucuguagcuccugcuuuuuauuauuccugguuggauugcaccacuacucaguuucuauuuuauaauacugauuauaaaacauggagggaaauaacuuuguauugguuuuuaugaauaauuuauuauguguccuagacucuggccuugucaaaagaaggacguaagaaggcacgauguauuauacuugggaaugauagaagagacugaccugguauuuccacccggaagagggaaaggauuuuaacuacaaauacaggaauccagcagauggcaucagagaacacuauaaaaaagaaacgauuugcaacagccaccucucuuccaaaacaauuccuuacuucuguggucugcaaggcgguuuuuugaauggaacagaacauaguaauauaggaaaacacaaugaugagaaaagccagcaaguucacaccuguugggaaaagcacacuuuuaacaucucaggcguaaaagucaacaguaaaauuacugugguacagguugaguaucccuuacccaaaauguuugaaaccagaaauguuuuggauuucggauuucggaauauuuacacauucauaaugauauaucuuggaaaugguucccaagucuaaacacaaaauuuauuuauguuucauauacaccuuauacacauagucugaaaguaauuuuguacaauauuuuaaauaauuuugggcaugaaacaaaguuugcauacauugaaccaucagacagcaaaagcuucagguguggaauuuuccacuuguggcaucauguugaugcucaaaaaguuccauauuuuagagcauuucaaauuuuggauuuucaaauuacaaaugcuuaaccuguacuuagauguuaaauacagugccucuuccacgggcacuuccaggaagcauucuuuuauauaagcccagugguguuagguaaaacccagguucaagggaauaaaaacaaagaaauuggguucaccagaugaaaaagagauuucaaauacauaaacccuuaugaggaauuauagacuucuaaaauucagaucuaggcauaucaugaaguaaacucuagcucuuuuaaagcaugaaaagaagcuauuuuuguuuucagcucucugcagauucaaaccuuaagggauuacuguaaucauaugcacaucucaaaaaauaaaaacaaccccauuuucuuauccuauaaacaugaauaauaaaagaauaaaaauaaauaaaaauaauuuuaauaaaugaauaaaauaaccuuggaauuuaucaugaauauaauugucugagaaacauuauuccuaauguuuuuggucuuaagaauaacacauaguugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcacuccagccugggcgacagagcaagacuccgucucaaaaaaaaaaaaaaaaaaaaaaaaaaaaagaauaacacauagaacaaaaauguauuuuuguuuauuuuucuucauguuucuuacaguaaauuaaacuacugugguucagaaccuuuagacuaauuuuauuaaaaaaaagaaaaaaguuaaaaauucaacuaugugaauuauucuuuugggcccaaauauauucacaagauucccaccuaacaucacuauuaccuuucaugcugacuucuuagucacucuuugcuuuauucuugcugucgcuaaaauccugagugaucaucucauuucucacagugaaaauaagacuugcauauauuuucaaaguuguuaaaaaauaugaaucugaaccuagacuguauguaagauuggugaagucuaggguaaaaauacuuuaaauucaaggugaucuguuauuuuuauccaaaucauuucguauucaaugaaaucauaguauaaagccauacgguaaaauuuuauaaaacuaguugucuuaggccucuuuccaaaaaauuuaguuaagcguaaaagauaaucacucuguuagaaaaugcuccccugccccaaauucugauagcagacuuacagaaaggaucaaaaguguauguucuaggcuggguguggucacucacaccuguaaucccagcacuuugggaaaccgaggugggcggaucgcuugaggucaggaguuugagaccagccuggccaacguggugaaaccuggacucuacuaaaaauauaaaaauuagcggggcaugguggugggcaccuguaaucccagcuacuugggagucugaggcgaaauaaucacuugaaccugggaggcggagguugcagggagccgagauggcgcuacugcacuccagccugggagacagggcaagacucugucucaaaaaaaaaaaaaaguguaugcucuaaaugcacgauaguaauauaagaaagauguuaacaauaggggaaaccagguggggcauauguggaaaauuguauuaucuuugcaccuuuccuaaaaugaaaacuauuuucaaauaaaaaauuaauuaaaaauuauguauucuuauauucuucaaacagaaaaaaaauuguacuuuagagcucugggacucuuccucucauaugcaaauugaugaugaugaugauuuugugaguguguguuugugugugugugugacgaucucuuugucuaucuggaauauaucccagauacuuaacuccuuugggccgagcuccaugccugcaugguaugcuccaccaaaugaguuucuucaguccuucaucuuacccuguucccuggcuuugagccugggaauccacuaugucuuccuggaacacagaccccaccccacccuccucugccuucgcuuggcuaauaccuccucauccuuugggccucaguuugaauucauuucuuuugggaagccuucccuguuacucagaucuggggcuccuagaacauucuguacucuuccuugauggcauuuaucagccugugugugaugugaggacauguugacuugucugccuccuccucuguggucuguaaggccuuugaggcuggaucuguuguuucucccguaccuaauauaguauauagugcacagccuauagugagugcugaauaaaugccuauuugaacaaugcaugucauggugugugugugugugugugugugugugugugugugugugugguguguguuucagggagagucucuauuaagugcaccuauguuaggaguaaugagggaaugaaugauaaggaaauacaaagaacagccuguaauacucuggauccugggaaugacauaucuaugaccaaauaacuaccaaauaggguagugugugagggguauuacuaaaguggugcaaacuaaauguucuguuuuucagaggaggaagagaaggaguaauggagaagaacugggcaugaugguuagggucaugucaugaugaguuuuaagugacuaauuuaaacuugaccuugauaguacuagggagccacugaaggucucugaguggagguguacacaguccuuuugauagucagagaauauaacaaugguagugaauagauaaaugagaggaaggggaaggucccagagguuacgagaccaguaagggauaagguaauaauucaggguugagggaguaagguuuccaacuaaggcaacagcaguggguagagacuggaaggagcagaagcagaagcaaauuuugaagaaaaagaaaggacagaagagcuuguuggcuccuuggaugggaagaaaagauuagaagagagagucaaaagaagaucgccccaaagagaggauauaggaaaggccuuaauucuaagcaggagggauacauauuagaaaauagaaaaaaaguguuuuuaacuuuaaagggcuaaauuugucauucauuucuaaagaacacagagucuucuuuuacaauauuagaaggaauugagaaaacuggaaaggaaagagcuuuauuaagcacccuuacauugcugacuuaacagcugcauuuaacaaaggcaauaaaccuuccugguauuuccauucagauaucucuuacuugucaguuuccugaguuuuauuauuauuuacuuaacucauaacuagauuguaaaaaaaaaaaaaagaguuuaaauaacuugguagguuuacaggaugaggcacuaaacuggaauuccuucagcucauagucauuucauauaaacaugaaaucaaaggaucuuauggauaauaaaaauaucauccagagauccugguaguaugucuuuauuuuccacacuaaauauugucuaauaaaaaguuuaauaaaacuucaauaaacacaauaguaaaaacuuuuuugugugaaaaaggacacagucuugacuauguuaucucacuuucugaaacaaacaaauccaccuuugcugaaauuuaacguauuucuagcaaaauuauguuuuuccaggaaaugaaaaaauauaauuuaccuaggaaaauuccaagagaauacccuuugcuuccaauaucuucuguuuggucauaauaaagugggaaacauacuccauuuuucccauaaaaguuuccaaaauaauccuuauuccaaaauggaauuacagcuauuaaaaaucccgccauccagaugcaaaugaggaugacugaggucugccguuuuccaggucgaauguuacugaaggggaagacaaugaccaggaacuucuccaaagucaaguaggucaguagcagaacagagacuucgguggacagcauggccaggaaccccaugaggcggcacugcacgcucuccauccacagcaaggcauacuucugauacugcccucgguauuuuauaucgaaaaugccaacaaagaacaaguaaacacccaucaggcaaucagcaccuguggaagaauugaaacaguguaugucaucaguuuccaaugucccuguuuuaguuuucugauuaagucuauuuccagcauuuuaauuuucuaauuagaucuaguuccuuucaucuuauaucaaaugaacuaauguaaacaucugaguaccaagaagcgaguggacuuaaaaaucuguaauauuucuaaaguacuacacuauguuuuuauuuuguaguuuaaaaaaaucggaaugggaauuuucuggaaggaggaaggacuaguuguuaaacaguuaacauauaguaucuucauaguuaauaaagggaaucauuuuccaggccuaaugagcauagguaucauuguaauugaaguucagauuaguuuuaucacccacaaaacuuuauaaucugucacuugacucauugguugccuauuagcccauucccaagacauacuccugagagcaggccacuguaaggucauacaaccuaaaacaaagccacaaagagccagaacuuuuauauuuagaaaaaaaaaugugcccaggauguauaauucacauuaaaugccauuuguugaaagccaauaaauacauauauaugucuagugcacaacucacagaagauauccuuaaucuacuuauacuggaaacauacuuacaacaaaggauuuugauggacauagcgugaguuguauuuucagcuuuaaugaaagaucucaugccaaugacaaaaagauuuccaaagcagguaaugaaagcuauaacccagacaaauauucugaggauauuguuagccaagagguccucaaaugaagaaaugccguccgucaagggcauacauauucggacauggggagcauaggagcaguaucgaaaguuuuugaaauaacuaaagucaaagggaaaaaaagugucacuuugcagcaaugauacagaaccuacaguugcaguccuaucggggcugcaacuccaugcuagguauacaacuucacuagguuuguuuauuuuuguuuaguaguguuuauauaauuaaagaguucuucaugaaacacuaggcaguauccuuuuaaagaugaggaaccuaaagaacauaggaauucaguaacuuggaugaggagaguuugggaggacaugaaaauuugaaaucucaggggcuguauguucccuggucacauugguuuauugauuauucuguaagguauuaugaaaaguggauuauccuugucaaagugaucuccagcagacuuucaggggcuugggcuugggaugggaaaagccuauugucgcucaccuagaacauuucugucuuguccugaguuuuaaacaccgaggucuacugacuuuaacuagccuccucuucccugacacuggcaggaagggaggaccucugacacuaggaaaaugcauucucacuggaucugggaagagaagcagcugccuuaaacacagauuucuuaccagggucuggaaggaguuaguuucuaugggaaaauaaguuuguuuguggucagugggcacaaggcaucuggaagugcuggaaugggugaggucaucuggccauugccaucccucaaaccuguguguuuagaauuuucucucauaaaacuugcucuauuuuuauucguuugcuacuucuuucaguucacuuuucugcucuuugcugucaguuuaauucauuuuuuguuauuucucaauucaguuucuagaccaaggcugccugguaucagaccccuggcugccugcaccaccucgccucuugcccugcaaugcuuacuccacccagacacacacccucagacaagccaugcucaugcccuacucagagcuuugcuuuuucuuaugccccugccuggaagauucuuccccuggauacugccagggcugcuuucucccuccgcucaggucugcucaaaugucacuucacuccaacuuccauccaccccaccucagugguaauccucaauccuccuucuaucccuuaccuugcuuuauuuaaauuuguagcacuuauucacuauuuacucacuugcuccuuuacucucugguucccaaagcuaaauggaagcucucaggcacagacauccucucuuuuguucaucuuuaugucccuggugucuaacgcagugccuggcacguguagguacucaacaaauacuucuuggaucagcaaguggaugaugaauaauuuagcacugggugugucaggaagagaaacaggaggcaauucuugccuucaaguagcuuacaguucagcuuccuaauaucuggcauccaauuaaaggaaccugaacuauaaugaacucuuuucuucuccuucccuggagucccuggcacacacauggcuugacuucuugguccuuuuaggauuccauuaugucugcuaucuucagauagaaccgucuagcaucucucagugguucagggcccccuugcgcugugaccacacuacucguugucaggugaaagggauuggggugacaagguggggauguuucaauaaauaaaggacaaggaauaugaaagaagaguaaguagguuacuuaguagggaaguaacuaagcuaauguguuuucucuuaauuguugaccuguucuugaccuuggccugaggucuauauuuaacacagcaguuucuccaucaaguucuaaauaguuugaauuucucuauacuaagaagaccccauauccugccuacaacaaggaaaugauacccucauuaaacauuuaucuaauagugccacagaagaaaaugaacaaaaccauguggaaaugcaucaaacacuugucuuuuaguaaucacaccuacugcacagacauaaacaaaauguucucccaaaagagcaccuucacagccaccauuucauccacuugcuguacccaacuuguaaucuuacauugaauucucccuauuuuuguagauaacaaugguuaauuuuugaagucaugaacacauagauuacacaguugauaaagaaauaauuaugaacacauauauuaacacaacuuacacagugcacuuuagccaaauauacuaaagugacuuaucaaaaacuacuauaaagauuaauuaccuccauuuuguagugcacuuaguaacaguaacaacaccuggaauuuauauagcaccuuucuuccuaagggcucaaaucuuagagcagccgacugcucauucaugagaggugaauuaauguuuccaggucgccugaguaccauuuagccagugacuucaucuuguguaauauguggcauucugguacccugaucucuuauugggccucaauuggauaaacagcguguuuccagagagaagggucauucaugucggcacaucauaauauugaacucuauuugaacagggaccaaaggugacaaaauuaaaaaguucucaauaaaaugacuuuuguugcauagaaacacauugcagugauacauuagacaguuuacaggagauaauuugaagcauuuuaccaugcuuccuccuccauuuuuuauacauacguacaugugagaaagauucuucauggguugaaacauucguguguuuauauuuggaaucucuauccuuuccaggucucuggaaaauacacacgauagguuuaaugguguugagaugaaacguuuuaauaauugcauucuucaucauauccgaaauauaaugcuucaagaucuuauguuaccaaugcagauuagaaugaaaguuuuacaguacacuaucuuagaaaauggcuguuucuauuuaugccuccugcaguuuggcgcugauugugucauuucacaugcagaauuacauucuaauagaacauauucauucauuucuuugauuuaagaauggcaguggugauuuguguauuaugaaauuggcucuguaguuugauuuuauuaauauaaguaaugccauaggaauuagaggguuuaauucaggagaugaucuuuccaaccggagagcaucacugaagugaguuuugugagaaucuggauuuaaauaugaucauuucuuccuggccuaugugucuuuaggauggaaaaccaugaagguagcaagaggaacuccaauucaggagucuucuaagacaccagugguaugucuuagaauuccuuuaauuaaauuuaaguuaaauuuaauuaaauuccuuuaaauccuucaggccccauaaaauguccucaaagggauccaaggaucacuccuguucucuuaguugaccucaaugcuugcuucuacaaauguggacacuuugaagaucucuuuaggaugguaugaauuaagagcugccauguucuuaggaagcagauggagagagauaaucuaaaaagacagaggccuuuugcuuuuaauguuuauuuugaaauaugucugauucucacuugguuucuuuuugacuaauccgaauaaagauuucucaacaugguucugaguuuuccuuugcccaaggaguucuugcuuuuuggaagucaaaaaugaaaucugggaaagcuguuauacuacugaguaauugcauggccccucuagcaggagacucuaagcccuuucuaaaaguuuaauuuuccuuuuuuuuuuuuucucucuggcucuguccuugacuuacacaguuuuagcuuuauguggauucugugauuauuugauuacuaaccuauagcauccugaagagcaggggccacuguaucccaagugcuaaaacaaugcuuuguguaaguugguggcuaagauauguuugugaaauaaauggguaaaugaaucacaggaaaaaaagaaagacugggcaggcacgguggcucacgccuauaauccuagcacuuugggaggccaaggcaggugaauugccugagcucaggaguuugagaccagccugggcaacacaaugaaacccugucucuacuaaaauacaaaaaaaguagccuggcauggcggcguucgccuguaaucccagcuacuugggaggcugaggcaggagaauugcuugaagccgggaggcggagguugcagugagccaagcuugugccauugcacucuagccugggcgacagggcgagacucugucucaaaagaaagaaagaaagaaagaaagaaaaacacuaaagaaaaaaaguagaaaugaauaaagaaaaguauguaauaaauaauuacuacuuugacuuucaggaaggcauuauguagugacuugguauuuuggcuuucagaaaugcaguaugcgguaagcaaagagaagaaucaugcuguccacauccucaggucuguccuuauauuuuaaaaaauaaacauauauguuuaauauuauggcuucuuaagaauagggaccagaucuuuuucaucaguggaugcucacuaauaucugguaagagagaaaccuaaaucuugcauuaauuucugauagaaaacuagcaagaauaaaagaugauacuaagaauuggucuuuggaauuaaaggaggaaaugcuuuaggcugcagucaggcagcguagucugcugucugugugaaaacaaacaaccuuuagccagcaauugccauccauuggaaagaaaucaugaaguucaaaggaaaaguggcagaguucuugauaccacugaaacuuaauaugguugaaauguaaaaauacuguacauuaauuuucugaaugugcauauuugugggacaguuuuuuaaaaacuuauuuaaaaguaaaacaaugcacuguacacuaauaucaaguagauccuuguaggaaagggcaaaggggaaaagcaggcaagucuuacauaauuuguuuuaaccaaacuuuuagaaacaaaacuauugcaaauuuaauucuuugugaaaacuguaggaugagauuuugccacaugaacccaguuuucaagaaggacauuccugaaaccuucuucaaguacagaaauggacuucauacaugucgaaugguaaauaaugaggcuuauuugucauucaguauguacuugaugggaucugugauucagacaguugucugaaaugcaugcuccugugugcaaaauacccauuuaaaaauaaaugugucucuaaguacauccacuaaaauuauaaucaauauaauuguaauauuucacuuacagagacugaaguuguuuaagacuuucaaacugguucuugugaagauacauaagaggauuggaugacagguuccuuuuuuuuuuaccauuagaugagagaggaaaagaaguuugaagguauuauuauuuugaaagcucaaaauauugcccuuuaaaucugauuauggugagaaguagaacuuacagcuuuuguagaagcuucaagucuuuaaaaaggugaggugauaguuccguuaucguauugcuagacagaucccuguugacgacaaugaaaacccaaagcaauuacuuuggaaguaaaugacagacuuauuacuccucacaauuaucaucaucccauuugauguaacagaaaauaugaauccaauuuaaccaaccugauaacuuguuacacaacagggccguaugagucagccaaauggauacgguuuccaacacuuacauguaacacuuugcucguccaguuccuaucuggaauuuccucuuacccucucucaaacacauucccaaccuggcuuucauaucuaauuugguuaauuucccuugcucuagauacucuuuguacacuucuacucuucaugcuucugugauugccacuugcuucauauacguggucucuuguuuauccaacuacacuuuucgaggucaagucuugcaucuuugauuuguuuugcauuccaaccaagacaauauuguccacucaguaucugcccagauaaucuugaauaaguucacacgcuuuuaauauguucuucuacaagacuauuuuugcagaagaaauugcaaguuuagaauuaaauauaauaggacuguccaauccagacagaauccuaagaaagugacucuauaaaauguggaaaagagaccuguuaaaaucagaagaaaugaaucuuuaagaguccagaguauauuucugagccagagaagauguuaaaacagauauacaguugccuaacuaagagucaaacaaaaaugaucucuuuugauacucuggaacugcugaugguuaugugggaguuacaaauaacuaugacuuagcucuuuuuguaaagaagcuuacauuuagaguagcaacuagauacaaacaaggaaacaaucaaacaggugcuauuauagaagugcagagaaaacauagaggaaagagucaucagucuuggccugggacauuaggaaguguuugaagaaagcuugaugauuuuaggugggguaaaagaagaacagcuucucagguggguguaaaaaaugaucugaaccacagaugcuuggaauucagugacacuuucaggagucaggaagugauccaacauggguggaggaugcaagauguagggagagguagaggacgucauggagagugcguggagacaaaaugggaaagccaugcgugcacuucaaggcaguaguuuucauaguagaguccaagcauccaaguccccaaggaugcuuauaaaaagagcacauccccgggacccaccuuggaacuaucacaucagacuuucugggagggagccugguaacaugcauuuaagccaauaucccaugugauucuucggcccauuaauguuugagaacugugucaaggacuuugcuaaacaccaggcaacaagaaguaagaacauuaaauagggcaauggcaucauuuacuccggguuauggaaugauuauucugucagaagcaugaaagacaggcaacaaggccugggaguugggggaggaagaccaggcaggagcuucuacauggaccaggugagagcaaaugaggguuaagggggacagcagcagggcucagggucuggcugaacauguauuaagagaaaguuggagggaaacggaauggucuucaagccuggcuaccaggaaggaggcacugagauggcaaguccaggugaagaagcuggccaucagguuggggucucuuguuaguucuguuucaaauggguugcuuuugaggugcugucaugacaccaaagucugaaguccugccaagugagaugucucaucugguccuccagaugagaggagcacaccuagaucucagcccagaagggagaccacaggugcacacaggccagagagagccugacaauaaagcaauaugaugaugauuucauacaccuagaaaaugccuuucaaaggguuacccagaaaaauaaagcacacucuuuuggaggaaaggacuuugggggucucaaguacuugugcuuauuccucccuggauggguuuguugccaugaaggcacaguaaaacuacuuaacauuuguaaacucaagacauaugaaugccuuguucuaguuaagccuaccagcuucugaauuucuuuuagcuuucugaggcuaagugaauugcaauggaucacuauagaucuuaauagcaagcuggcaucucuuaagugggcucuuauuuuuggugugccucugccuauauguaggaugcgaagaggguuaggaaaauuuuaaaaauauggacucuguaccacuguuuccuuaaguuuauauauaaaauaccccucuggguugggcgugguggcucacacuuguaaucccagcauuuugggaggcugaggcggguggaucacuugaggccaggaguucaagaccagccuggccaacauggugaaacccugucucuacuaaaaauacaaaaaaaaaaaaaaauuagccaggcaugguggcagguaccuggaaucccaacuacucaggaggcugaggcaggaggaucacuugaacccaggaggcagagguugcagugaguggagaucaugccauugcacuccagccugggugacaagagcaaaaaaauccaucucaaaacaaaacaaaacaaaacaaacaaacaaacaaaaaaccccucuguuuguccuggguuauuccuccaccccaccaugcaacccaaguccacagucauccuccacagccugggcaggaaugcccugggaggaagucuuuucugaaugagcugccuuuaaguuuuugccuauaaaaugaucauacuuucaguucuaaugcaguaccuugcacauaccaggcacuucauaaauauguguggauuugauuuaugaugcucauuaauuagauugaauuaccuuaacuauucaugaguuauuuuuuagauuacucuuauuauuuucuccaauccuuucuggauuucaaaauaagguguaaagaauggggagagauuaauucagaaauuaauuuccauuuuaaggccucaaucagaaagaugaguuuucuauccuaaucacugcuauguguaauguaacagacuuaguuuuaacuuccacugauacacaauuauguggggagcaaugaauuaauagcgagagaaaugauuuuaaaaggcuuagauccauaaaacaaauauuugaacagaaaaaauucacaugagcucucugaauauuuuuuccgugagccuaacccucauucucagcauugggauuugcuucaccugcuauauaagucauaauuucucaaggacuaguaagcauauuuguuccuuuguucaguuauaaggaauuaauauuauuucaguuagucaguuauucauuaucaaacauuuauugggaauuaacuauacuccagucaguagaaagaaaugaucccuguguuuaagaagccauggaaaacucauuuacucccaaacacacauaaauaagaaaucacccaaagaaaacaaguagagaaacuaggguagguuaaauccauauuuagcccacugucugauuugaaugugcuuuggacuucaggauaauguugguuuucuuaauugauuuuuaauauccaauagucuacaggauuuugauugcuacuaguggcaaagcagucucacuagucauuuaaauuuauaaucucggaagaagcaaucauauuuuccuaguagacgaugcuacuuacaguucuccuaaauuuuuuaaugaagaaaaugucuucucuggaacaaaaccaauuugauuucuaggcagaaaccuguaagacauggcgagaaucagcauguggguuugcgucugcuguaguaaucaguucucauugggagaggccacugauccaggcagaauuuuauaagccuccuuugaagucuucaagggaggcaucuuuuggaguggaaacuaaggcaggacuuuuucaccguggacauccccauguucucuucaggaagugcugucaugagcaauuugagguccugagugcggucuagaaagcugcauuuuguuuggaucuaauuauuuuagaaaaugucucuuuuaauuuuccuuuuccauucuuuuuuccaaucauccauccaaucaacaaacaucacuaagugcuuacuaaauguggaaaacuaucauuaaaacaaaaccaaaacacugauguuuugaagcuuuccagcaugaaugcacugauugaccaaaccaucugccuucccgcccccauaaaaaauauaaacagcgaucagaaucaugaggcagaaucuuuggccaaucagaaugcauuagauguuuuuccuuuuagaugaaauuaugauuuuuuuuuucuuuagggagaaagacaucaaaugguaagagucauuggcuaaucauuguaaagcuaaucauuguacagcuaaccccuuucacauacauuauuucccuuccuuggugaccaugggguuaggaaacuggaacuuucaggucccaguucagcugagaaggugcacggaaauaaagauggcacaugaugucccuaaagggugggcaccuuaacuugaggcucagucccaacauccaaaucaauaaaucagugugugcauuuucuagcacugcagugucagaccaaggcuguaaacaaaacacuacuuuaaaauuuuuugucaauguuuucuuuuuaacuuccaaauauauaggguuuccccucauuuagugaaguccauuguauacuuacagcacugugagcgaaucgcacgacagaaacguagaauuugugagauacuuuauucuauugccuuccaaaucccuggaagucauggaggaaagauauuuuuaauauuuuuuguacaaaucauaugcuuagagauacuuuuuaaaaugguuaucaaguuuauuuuuacuucauuccaguuguuacuaucuuuccuccuaauuauugcaagguuaguauaacuaauauuaugcuucuuucccccuuccaacuaauguuaauaaaauugaggaaagggcagccuaacuuuuagcgagcgucuuucugugcugaaugcuaugcuauuaauuauaauauugcccaacccaucauaaacuaccauugauugggcuuuuauggugccaggugcuguucuacacgcaucacacagcacuccugccaaauugcugcuauuaucccccauuuaacauaagagaaauccaaggcuuuuggugauucacuuuccuucugaccacacagcuaguaagugguagaacugacccagcucagaucugucagaaucuaaagccuagacacuuaacuaccaugucuguggcgucauugaucauuauauccucacauucccuccaacaucagguagauguucuugucucuguuuugcugaaggagaaucucaggccaaaguuauccugcacauacugaacaccagagacaggaugugaaucccgaucugugugaugccaaagugcaggcucuuucuaugaugccucaaggacgcuaaugccaagggcaaugcugcucagaauggcagggaugcaaccucagcgcugccuggaacuugcuagaaaugcagauucuugcccaagaccgacugaaucagaaacucuaguacugaaguccagccaucugugucucagcaaguucgcccauuguuuacgaugcacgcugaugucugagaagcacugcuggggagauuucauuuugccagguaauucugcaggucaguggcaucccacauacguggacagcgccuuccggaacacucugacauucccucuuugagcaaugcgggggacuaagaaacagcccauuuuucugccaagucuccugauuccuuuucauagucagcuucuuacaguguuccccaaauauggcaauagcuauuuuucuucuucugaacuuuucucauagucacacuaaaaucaccaaucccuuugucauuuuaagaaaauccuauuuuaaaacuaucuuggagauuuguguaggaacuugagauguacauuuuucacacaauauacugugauuaaaaauaacaaacaccauacucuccuaaaaauccaaauauugugaaauggaauggaaaaaauguuuuucauguucuccgaagaaggacacuuugguguugugggagcaauuguccaacuugacagcaaguaacggaagaggagaagccuccccaggacagguuuucuccugucuggccuuucuuccugucuggccuuucagcuuccuacccucuguguugaaaggcucucaauugcaaucaggcugucuugcuaccugugcguuuuuauugugugucuauuuuuucccacguguuugugugagcccauugugaaaauaagugucuccggaacccugagcucugaggcugguuccucaccuccugcugacugaugccccuuuuggggagggagagcaggcugagcuccugauauuuuucugcuaccuuuacucuuuccuguguguuucccauuguguauaugcacuuguuuaguuucuaaguauuuucuuuucaccuauucuuauucucaugguguucaggucauuauuuccguuuuuaauaguggcacacuuacgugagaccucuacuguuuuagaagccuuuugacagcauauauuuaaauaaauacauaaaaauaaacaucagaaaauaaacacaacaccaccuaauaguguuguaacaagagauuuugagguuaguuuagaggggaucaaaagcugaaguacuaaaacuuuaucaucuuaugggucuugaguuccaugauuugacagagaagaguuccagcagcgcuaccaucagcauuuucauggaacaggaaagcaauagacaugacaauccugguuguugcagaagaccgugaagguguauguggcagggaaugguggguaaugguggugaagguacgacguaaauuaaaugaauguuuuaaacagguauugguuaaaagcuaacaaggaguggaaaugguuuaguacauccauccuaacaaaggcuuauugagcaccuauuauguacuggucauuguccuaaugcugggguaggaaaucauacuauagguuucugccuucccagaauuuauggaacaguauagaagacauaagcacugaggaggguggaucaccugaggucagggguugaagaccagccuggccaacauggugaaaccccaucuguacuaaaaauauaaaaauuagccaggccugguggugcaugccuguaaucccagauacucgggaggcugaggcaggagaaucacuugaacccaggagacagagcuugcagugagccgagaucgcaccacugcacuccagccaagguaacagagugagacuccaucucaaaaaaaaaaaaaaaaagacaagcccaaugacuauauggugauaguacccugagauagggaugagauaguacccugagacagggcagugugguggaguuuuguagaugauguaaugugugggaguacauagguggcugcugaaacugguuggugugucaggaaugaccuccuggaggugagguuuaaguugucuuucaaaggaaauguuuaaguuauccaaaagaauaagggagcaagauuuuuuaaguccaaggaacaauaugcuuagggaauugacuguaggaguaguaguuugauacaugcauacgagggucagggauagcaucuagaugggguaaggaauggaaaaugagggucuuggaugcucaaagggaaggucaaacuuuacccucacccuuugggaacccucaaauaauuuugaaacugggaagguaauaugaucagauuuugauuuuggaaagaaauuauagauggacuuucuagguaaccuugaauuaacuuuauggcuaguuuccuuaaucagggcaaauaacaaauuaauuccuaaauaaauacucacacccaguugaguugaggcauuugggcacacaucugcuugggaagagcuucuaaguaguuauuaaccauagaccuuuacacaaagaaaauguuaauuagaaauaaaaugauaugacacuuuuaggacagucuuuuuauuauuuuaaaauuucaaaacuugcgugcuaaaauuaauaucuuaugaugauaacauauauagcuauuucaaaauggucuuuaaaacauguguauggcaaagauuagggagcagauguugucaaagaaacuaugaaugcauaaguaugauacauauccuaggaauagauguuacacaguuuaauuuuaugagaugaaacaaaaguauauauuggguaauaauuuugaaguucaugguaauuuuccuuguaaacuucacguuguaaucauuuccagugccauacauccaaaguuucuucuuaagggcaucauuaaucauuuauaauauuaaagggccacauuggaaacugcauuaaauuggagaagugacaguagggggaauuuggggaaagaaaacaacucuugagcauguuaagcugcaggauuaauuuaugauauugugguuccuuuugacaaauggaaaaauaaugauguuauaugaucaguuguaaaggaauauaauaauccccugcugauaaaucauucuaguguauuaauaaacagugaaaauauuauugugagacagcucucuugguaggacaaagauuuugaaaguuucagugagucuugcugggcaaaggcacauuuucuuccauuaaaaauggaguuggagaugaacuccugggagauucuaagaaaauauaaacauaggauauaaaaauuaauacuaucuuuggucaaccacugcaaauaaaaacaugccuuaguacuaaaggaaauuaaaagggauagaaaaaucaacuaguaggcuuaaaauauucauuaugaucuggucagcucuucccuuugagccauggccaggaaguauuauauuaacaguaacuguggcuggaaacacaggagaaguuuugacuaauaaaaauuuuugugggcuugauuuuuuuaaaaguucuuuuuguaagcuagugcuagaugucauugcaauguaucgauagauguauugaaagguugaugaauacuuacaggaaaaacaaggaauuuaaucccguaaacaagcgcugugaaauucugguuauuggauugucaucuagaauucugacaaaauguaucaagaaacauuuccaauauuagagacauuugugaaauaaaaccugccuccccucaacaccuggccuacuccuuugugugcuuccauacuuggcucaccugucccuucccugagagcuuuuccuuccgucugugguuggagcaacucuuuccuccaaauuccuacagcuuccaucccacuuaucaaguuggauccugauuguuuugcuuucucccugcugccuccaccuccugcuggacuuaaagacccagguuguaucugucaccucuggguaccugggucuggcacaaacuccacguauugaaugcauuugggcuccauaaaugccuuaaccuacuaauuggcugagcugaaggaugaauuaaaguauaauuuuuaggaaaucacagaggguucuuuggucacaugguguuaaacugauguauuaaauaagguguguuuaaaucaauggauggaugucacgcuauucauaaggagcuuucugggugaaagagugaaacuauuugcauauucaaaccacuguuuuaaacuauauuuuauagaagaaauuagaguaaggggaaauaggccucuauuccucuuguugccugugaagccagguuguguuuccucuuacuugcaguggccggugagggcaggagugggagaaggaagccacauugagcaccuacuauaugccaggagcuuugcauguggaacuguuuaacuguuaugugauauaauccucauaacauccuucuuggaaaggaauuauaauuuacagaugaaaauaaagaggucuaggaaaauuaagaaaguugccugggcugggcgugguggcucuugccuguaaucuuaacacugagaguauuaggcaggcagaucgcuugagcucaggaguuggagaccauccugggcaacauggugagacccaccccauuucuacuaaaaauacaaaaaauucgcuggguguaguggcucacacguguagucccaacuacucaggaggcugaggugggaggauugcuugagucccagagauugaggcugcagugaguugagauuguaccagugcacuccagccugugugacagagugacacccugucucaaaaaaaaaaaaaaaaaaaagaaggaaagagggaaggaaaaaaggaaggcaagcaagcaaacaagaaagaaagaaaaaagaaagaaagagagaaagagaaaggaaggaagaaagagagagagagagaaagagaaagaaagaaagaaagaaagaaagaaagaaagaaagaaaagaaaagaaagaaagaaggaaggaaagaaagaaagaaagaagaagaaagaaaggaaagaaagaaaaaguugccuggaaggcuaagcauggggcuaagggccaggcacacagaagggcuuggaugaaguugaggcccuggcuuuuuccacuagaccaggccaaccugcagaaaaugggcaaacaauacagaaagccugcuaaccgccccuuguguauuuuccuggugaaagcacagacaucugacgugagguuucuuggaacggagcugguggcucagucuggaaaguggugaaauacuacaagcuaucauguuuucagacuucucucugaaugcucuggaaagcagaacaaguucuuaacuugcuuacuuuucaguacagugguuuucagcagaggucaauuuuuccucccaagggacauucagcaaugucuggaaacauuuuuaguugucacaacucuugggagaagggguauacuacaggcaucuaguggguagaggccacagaugguucuuagcauccuaaaaugcacaggcacauaaccacuacuugacaugacauugaauugccuggauaaaguucugcagauuauaugauaaucagaaaagcaaguauaaaaauaagauaugucaaauaguggaaacuacauuagcacuguuauauaucaucaagacuaugauccucuaugggagaaagaagaauuagaguacuuacagccaaguuagcugauguaagucuuugaauauuccaggucugaggguugugaugcaguugugguugagauaucuacaaauagcaugggugaguuaauuaggcaaacucaauacccuauuuuagucacauauaauuagaauaugagccacugaugaugauuauggauauggacaucugcgucugaaaguauucggcugaaugagcagagggggcaaauucaagggguauccagaagguacagauaaccacaagcccagugugugcaacaccagggccagggcagagaaagugguccuaaaauguuuugggauauuacaucauguuagauuguaaggguauaauaacuaaguauguggggcaauuuuugcuuuuguccuuuuuggugacauccuuaguagacuagcauuuuaagaaaaugcauagcaaguuagcaagaguuagaaaagaaauaaaaugcuaaaauauuguggaagugacccaagcuagagaagacaagguuaaggagaaccuuuguaugucuucugguaaagguaggaaucguuuaauaauucuuucaguguaauaacuaaucuaaguacuuugugauaaccuauuccucccacuucccuacaaucaagucgagccuugaaaaaguaccauucuauccuuuuagucuuugcuuaaaauuauaccuacaauaugagaaagagguuacucacaauauuugcagauuacauaauccaaaaaaugcuuuccuggauaugugucuaaugcaauuaugcugaagaaaucugguaggaauaagauaagagagucaggugauuaugguuuauggacuauauuagguuguugaacauauucuccacuuucuuuaccugaagacaauugugaaauugaaguacgaaguccuauucucauguuggggagauguugucagugagaaauggcuaccaacuagccagugcuuuccucauaguacucaugcaaugagauugaggcaucucugauucauacgcugaacuccagugugaugugucugcggaaggaucuagucuuguuucugcaaacuggcacuauggugaccguccuguucugacuggcaggaguuucuggccaugugagacuagccagccucgcacugcugaacuuucuuccucuuugugcacagagaugcaccuuuaacuccucauuuauccuuauucuauucccaugaaauaaaggagagggcaagcuuuaauucuuuucuauuucaugaugcaaagugagaaggacaaggcaaguuagguacucaggauaucaaaggacaucagcaguugaaccagggcaaguaugccaauuucaagucauaggaucaggacugacuuaaccucugaagcaacuuaauaguacaguauugauuccguaauugcgcugucaggaguaucuaaguaaauaauuuccauuugcugucuucauuguacaaugggaaguuagcucugaauuccuauucucugaaggcucucaggggcaggaaauaacuauacuaauaguaacaaauuguuacauagucuuuugaauggcuuccauuucucuuauuuugguuugaauugcuuccuaaacuauuacacagcgcuguuucauuguuaugauauucuacugcaaaacuauuuguagaucacaugcucauuugacgucuggcuauacugugaauuuuguuauaccaugauuauuuccuagcagagcuccccagccuuugccucugagucacgauugucuuauaagagugccaggauggugacucuuucagaccugaagagagccagguaaagccaagauuggagggguuaucagaggucaggaagcggggagaugaagggguacaaaugaauauuuacuaccacuaaacuguacacuuaaaaaugguaaagaugguaaaguacacuuauuuaacuucaauuaaaaaaagaaagugaaaguaaauaaagauuauuagaaaggaaaaaaaaaaagccaggacaggcuuccaguuaucagcaaacacaaucuuuuaccccaaguacuuuacaaauacggucauuuucccuauguuccuccaugugccaaguguuggcacuacagaacaucacaucuguggugauaugcaaagcaucaauuucaauccugcaaaguaaacuugaaacccagugugaccuugugccaucuuaacccccauucccgguaccauaucuauggggagaugcuucacagagcagcauacauucugcuuuugguugaagguucugcugugaauaggaugaacucacacagaucaauaucuguuuuagcacuuucagagccuugagacugaugcaaugaaguuaauaugaugaauuauguuacaguagcaaaugaaaauagaaaaagagcaaaauacuguauuguagguauauugaaguuucucuuaaauauacaauucacugcuuaacuaaugcuauuuacauuuuauucaagaugagaaauucaaaaauggaauguauauuuuaccuacauguugucacaucuugaagagaugaaugcaguugcaaauugugaauuugaccuuacgcuuuugucuuauaagucaagggaaagaaagaguaaaaccagugauccacacaacucaucugauguguacaaccuaucucccuucacugacaucaguuaaaacucaaacucuuaaauaaugaagagcuucuagucuucuauuuaguuagcugguugccaccccauagagaacuguagucccuccuacguuccaugucucagacuuaggcugcugaacuugaacuccauccucuagucucugcugucuucuuugcagaauaguagcuuaaagaauguguggggauauuuggaaacaugacaacuuggcaaguggcgcccucuuuuuauucagagcugagauauaagcccauuuaauauacuuuacaccgaaugccuuuucuaaggauaacuuacagguucaugaauuccugcaguuucagcugucaggacuuuucaagcagaaaugccaggaauuuauguacccgaaacuaaagcaaauaaaugcuuuaaugacaugcauguuuauaggcaauuuuugaaugugccauuuuguauucaagagccaggcagacaccuugaguuucguuuuguuuccagugauuguauuuaacaagaacccagauuaagaaggaauuccuaauuuauaaaagguuuuuguuacaauaaggaggagaacugcuguuuguuuccaugguagcagugauaaaguauuauagucaauuccauaaauuguauuuuauuucccugaaaggucauuugaaacugcauccacccccaauuuagaaaggccugacauuuuaaaagauuauuaaaaugaauaaacugaucaaugguaaaaacauucagaucaguuaagcaacacauucaucuggcaauuaagauuuaauuuugauuuaggaauuuguuuuuuguuuuuuuuuggaugccuaaaugaucucaacuccacugugaauauuuagagcauuccagacuggagacccucuugacauuaaauuuggugaucucgcaggacaacaguccccacgguuucguagaagacaauuuuucuuuuuucuuucuuucuuucuuuuuuuuuuuuaagacagaguuacgcuccauugcccaggcuggagugcuguggugaguucuuggcucacugcaaucuggacuuuuuggggucaagcgauucuccugccucacccucuugaguagcugggacuacagaugcacgccaccaugcccagcuaauguuuuuguuguauuuuuaguagagacauucacgauguuggccaggcuggucucaaacuucugaccucaacagauccaccugccucagccucugaaagugcugggauuacaggcuugagccacugugccuggccaauuuuucuauggauggagaggggggaugguuucaggaugauucaagugcauuacauuuauccuuagauucucuuaaagagugcacaacccagaucccuugcaugugcaguucacaauaguguucacacuacggugagaaucuaaugccacugcugauccgacaggaggaggcagagcucagcuuugcuugcucgcucaccacucaccuccugcugugcagcccaguuccuaacaugccacagacugguaccgcucugugauuuggggucugggaaccccuggcauaggauauaucccaauacaacuuaaauaugcagauuaacuuuauuagcucaauacagucuaaaacacauauuugugcaugucuguucucugcucaaacagaauaaaauucagaugccuuagcuggcauacaaucaagauucagugaccucuccggcauacgcuccaucaucuccuguggggaugccuuuccuuuaggcaaacugcauguucacucucuucucaacauccuuugaguauuucugcuuauguuucuuucuucucccuggugaagaugcuccccaccuucucuuuaguucuacauguuagugcuacccaucguucauucagcaaauacucauuaguccuuauggguuucuuacuagguaugcuacgacacaggccucaauagacuaagagagaaccaggaggacuguccagcccaugaggaggguaugguggucagagaguuguuccuucgagaaggaaagugagggcuucaugaaaauagaauuguaguugacccgagucauguguaaaacucaaacaguagagaauacuguggcaauaaaaauguguaucuaguuggagaagcaagaaagugucaaggaaagucucaguuugccuccuggaaccuguuuuauaauguugugagauaauauaaaaggaacaacugcuuauuucucaacuccuacuuuguucuuguguucuggaucaaagaagauggucuuaggauugaagcaaauggaaaggcuauauggcaggucagugaaagcccaagaugguagaagguguuaaucaaaauuaauuaaagcccucugguuuggaaauuuucucccagaaauugagaaaugccaaaaaaugagaacaucaaauuaugaucaguugcugaggaauccagagaaaggaugagcagcuggaaaguaaaagauggcaaauguagucuuaaguucucaaaaagggaagaaguugguuucacaagcuguaguuggaugagcucaaugcuggucuugggaagaucauagaacaggugaauaugaugcugcuuugucuaugccucaaagagagagugaccaggagagcucacaagaaaccacauggcagaccaacuucauauucuucuuugaaagacugugcaaaacuaugugauaaacauuguuacaugucuacugggcauugaucaagcaguuuuauaauuuuuuauggacaaaagaaagaaugacacauauucuuaucugaaggaugaugaugaaggaauauagaaagacaauuuagugcuguucucuucaauauuuuacuccaugaccugggugaagguaguugaucuuauuugcagaugacauaauuaugagaggaguagugacuaugauggaaaauacaaaaagaccuucacacuccgguaagaaaagcugacucuaacaggaugaaacugacuagggauguauuuaaggacccaugacuaacucucaaaugcuaagugcaugaguacaagauguagcacacacaucacuuagcagcaacacauguggcauggaauuagaaauuauagaucacuaggagucaagaguaucaagaagucaucaaaagagcaauauaaucauagggcacauagagugcagaaggaaagggaugcgaguucuucccuauuugccucggucauguuacggugauaauaguauauuuauucuagaugucacccaucaagacaaauguagguaaacauaugcagauuauugugacuagaaugaagaacagauuugaaacuauguccuuuggggaggaauuuaaggaaaugaggauacuuagggaagagauuaguggugugguggagggugaugauagcuagucuuaaauaccuguagacguauguagaagaccaauuagauguguucugagcagucucuuggggguaaauuuaggaaugaugggaagcuuuagaggcgccuugagcagugguaauguggacaaaauuauuagugaauuguuugaaauuccauuuccccagcaccuucuaauccucuuucugguuuauuuuuagcccucaccaccaccuaacaaauuauauauuuuaaacuuuguuuauugacuaucuuucuugauuggaaauuaagcuccacaagcuuaauuucaucuuuucaucuguguuguucaugcuguauccuuggugccuggcaccuuguagguaucaauaaauauucaucacaggagugaaugaauaugugggucuugcuagcuacugcucuccugcuaccagauuccauaccaagaguucuggcugaggcccaucugguuucuuccuccaacugacaucccuuccuggggaugguuugguauuugccacauuuguuauuugggucauugaaugaggauugggaagaaaaagguaagaguagauggacaggagggacaagaaguaggacuggugcagggggcuauuuuucugggaguuuggaaaagagcaggaggaguugaggaauguggguaaaggggauggugaggaaaggagauuuaaggaagcauuguugagcuuaugagcugcucuaggauauuugaguauaaagaacuugaguuauuuucaaaucaaaguuuacuuacugggugguuucauugauaauaacauauucugagccuggacuaugugggugggcuuccaaaggagcauggucagaagguuuggguuugaggccaaucucuauuacuugucagcugacugacuuugggcaaacaaccucucuccccaaguagcuuuccucauuccugaaacugcuguaacggugucugccccaccucacagacuuuggagaucaaagccaaagugaaaauuccaaauauuggaauucuuuguaaacuuuaaaaagugguagaugacuguaagcaauuguguuuuaucccccugugcuuuaucuuacauauaauagacacuuggugaauguuuauugaugagagucucauaaccucuuuucuauuagucucugggaaaauuaaauugccugcaaaucaucaaauagcagcuugcauggggagaagcccugucaggugauauucagguuaugauguggugccuguuuucucugacaaaguagaauuagacauuuacuuagagaaauugcuagcuaaucuuggcaauaaagguuagucucuaucuuuuuucacuaggaaaauuguggaccugaauuauuaaauugcuucuauauucuucucuucagugggcuagcagggccugggaccacagagggagauauuggcauagaacacaguuaugaguuaauagaccaaggaaggacguggccugagaagucuaauuuuaacccuccugcuugagccucuagugacuccgcccccuccccagaagucagcuugccccagauuagggggcaaaacauauacaagggaauucuacauggggugggacagucugugcugguagaaauucaguugauugcuagaacuauuucuuucccucuuaagguuuccuguuaugguaaaguaagcacuaccuuggacaucagaagacauuggcucuaauucugggucuuccacuuacuaguuguagaucuuaggugagucauuuaaccauugcagacuuuagucacuucguguguaaugagaagauuuaauuagaaauucuuaaaacuucuaugacucuagaaaauagaauuucaauugcugugaaacaagaauucugaaacgaaaaucucuucccuuccuuucugcuagugcuauuuuauuuuuccucccacauguauuauucaggcaguacaaagacaauauugauucaucuaaugaacauguugugauuuuagggauuucuuggaagacuaggaagaaugugguuagaauuuccucucuagaggaaucuggacaugcagagccaaugcauagcuacuccaguguggcaaugacaugaccacauacccacauacuuuaggaugaagcaacaggucugagagcagccgggguuuacagaggccacaaucaagcccagguaugauugaguauugauguucacacaagguucuacgucauggacuuccauuagcuacuucuuuucuuguaugaggaaauuuauaccuaaauucaggaacacaaaauccuugaugguauuucaaaccaaaugugugugcccaguaucagcaaagauucagauaauuuuuauuccuggauuuucauaaauuucacauuucuagaaacuuuucuccucuaugcuggauauugaaggauaaaacaauaagaugaugguaccaccaagggggcuugcagcguguacagcauucucuugcuaauuuuguuaucuagucuaaugaucaucucagcagguguagccccuccagugccacagagcaacuggcccagagggauugacagauauugauccaacuuacaaaugacugauacacgaaccugaauauucuccauuuauuaaugugaauagaaagcaucccaucccacuuauaggaaugcucuuauucucuaugccaugcaacuuuucaaauacuuuaaaaugaagaaguugggaaauuaaauucaucauccuaagguuucuuggugaguagagaaucaaagcaaagggauuguucaugaaaauugugguggggauugauggugcauccugacccuccaagagagaucaucucuagggauuauauuucccaguucccgguuuucuuucuuggaugauucuggaagcauauuggcccuucuuugucacagaauaccuucucugcugaucauauccuauuuauuggcauuuucuuuccucagauauguuaauaucacugguugcauaacuccuguguuuucacuccuaacacccugggggauaucuguacccuaucauuauguaucugaaaugaucugauuguucuuguuuaugcugucacucuuuuuuuuucaagugaaaaagugccucugaaucugcaaugucauuuucccaauaucuugaggaaaauaauggaacuguguauuuuccuauugagauguuuuaccucgacuccaaguuaauucucugaaaaaguuuaaauaaaauggguucagcuccuucaaauuaugaaauggaaagauaacauacuuucaaauguuuuauuuucuaaucuuaauuacauuuagaaacauaaauguaaugauaaagauaacaaacaauauuuuauuuuuagaucaaaaacaucuuacaccaccacgaggauuuuuuuuaaauaaauaugcuauuaacggcuacuuacaucuuuuuaaguuuuguguauuugaugaaaacuuuaucuggaagacuguggauuuuguuuuucuuaagagaccuaaaauaacauguaaagcaaacuucauuauggauuguuauggccaacccacucuucccuagaagccacaugcuugggaaaagaauauuugaugacguucauuauacuaauccauauuugaacaugacaauaacuaaaaauuuuucaugggagaaugaaaaguuuauaaagcaaaauaaaguagcuugugaguauuugacaaauguagccaguuaguauaguagacugggaaguccauguugauuuaacuucuuuguuuuuacucugugggugcauuaacaaaccaaaccaaaccaaaaaccagccaaagaucccaacccacucaugcaugcccaaaugaugacaugacugcaaauuccugaggcuuucaagaacuuuaugcaaaguacagaaaauuuugcaugauauaacauagcuacuagcuucauggaucuuuuauaucuuugcagucuuggauagauuaccaacguuaaaaaaaacguagaauaagugagugugcuuccuuuuaaaacaaaaaaaaaaagcauuucaacacaaggacaguaguaaucauacauaaaucagaaagcaauugaaaauaagaacuccaggcccacagacauuugugagcuaacugaugacaggcuaaucuaacauacaguguguaaaccauuuuuucccccugaauaggaagcauggagaauucucugaugacugguaguuuuaaacaggguuucuauuauuuugcuaaugcacaagcaacacuauuggguuuuuucuugguuuucaugugacuauagggacagauaucaccaauaauuaaguuuuacucacaguaaugucacauuguuagaaaucaucggcacagacuuuaagucaccauuuacacauuccaauucaguuucuuugcagucacagcauuguggauacuguuuuagaacuaaugggacaaaaagaguaagauuucacuaguaaacaaauacauuaauuaugacuuugccuuuaauaacugauauuguuuucuuuucaucgaauguauaaaauuuacaucuguuaaaugaacucauucagccccuaauaaaauuaaauaagaauucucuccuacuuaaaugcagacuaauguguuaaucucaguucuagcuucuaguagucauuucagaggcauuuaccaagugauuggaaaaaacgcacaaaauguuaacuagcauaaacucaucuagugaagcaagauuaaguucacuucaaugaaaaacauuuguaugauugaguaauucuuaauggauaugacugagucaauucauuugaauagcauaaaauaguugcucaauaaauccuuauuguuuaaaaucagauucauuuuuuuucuuccuucaaacuucccuuagagccaugagaagauugagaugcagguucuaccauaaccacccuggcaccuuacuaaaauccauccagccagauauuccuucauuuugguucuuuguuuuuuauuacuaugagguugaaaguugaagguaaaaagcugcaaagcugaaauaaccaaagaucuaucuaucugaagcauucagaagaaagaagaaggacucaggauguacucugaagggacuuacguaguuacuaggauaaugacauguaaaggagugagaaaucuaaggagaagccaggccaagcugguccauaggacagucacugugugugugugugugugugugugugugugugugugugugugugugaaagagagagagacagacgagggcagaggagagagagcgaggcuuugagagaaagagcaaguauuuuuggagucugauuucuccucugagccuaugaauauuuguacugauagagcuaagaaugugagaguuauuuuugaauuuauuuuguuauuuauuuuaauguaauuauaaguucuuuucaggugcccuucuucuuuuagaucacuuuuauccaaauguuauuuuaaaaauaaauuuuacugaauuuuauuaguaaagccaacaaacuucuacugaguacuuaauguaaaagaugcuuuuaguguauacauuuuggaaaauauuuuauguugucuauacauauauguuaauuagcucaacuuccuaaagauaacuuucauaugcuuacgucaauguuuauugacauaaccaccauugaaauagugguuauaugauuaaauugaaaaccugugguuggaaacuuauuuaccaauagaauaauuucauauggucaagcugggugugcugucaacaccagaaaugugagcauuaacuguucacccuccaucaccugcaaaccaaucauguccccaugauuuuguggauucuuuuucugaaacuccuuuugcaucucucucuaccucaaucuucucaauggcauuuucuggggauuggaauaaacauaauaaccaguaacucuuuuaucaucauucuuucuccucuaucugaacaugauugacauuuuggaucaaucguucuuugucaugggaggcuguccuuugcauuguaggauguucagcaguagcccuggccucuacccacuagaugccagcagcaacccacccuccuccaucaggaugaccaaaagugucuccaggcugggcaugcguggcucacacccguaaucccaacacuuuggggggcugagauggguggacugcuugagcccagcaguuugagaccagccugggcaacaugguaagaccccaucucuacaaagaauaugaaaauuagccaggcaugguggugcaugucuguggucccagcuacucaggaggcugaguuggaaggaucaguugagccugggagguuugaggcugcagugagcugugauuguaucacugcacuccauccugggcaacagagugagaugcugucucaaaaaaaaaaaaaaaaaaaagucuccagacacugucaaacguucuuugcaggcacuguugccauggcugagacucgcugcucuaauccauucucugcaauucuaaugaaauaaucuuccucacauacauuucugaucacaugcucuuccuccucauuaagaaugaaagaaauauagaacaaaucaaacaaacauaaggcccaaaacuaugaugauuucccauucuauacagcaguaaccuuuaaaaugggaugugggcaagacaacucauuguggcucagguagaauaguagaacuuuugguuauauuuauuuuuaaucuuauccuuuuuuacuuucuaauuuucauacagaauauucuuguguauaauaaaauauauaagugguaauuauaaacugguauuauagaguacauaaaauacuaucaguguaguauuugauauauauguuauauauauacauuuacauauacauacuaauguauguaauuguacauucaucuuccuaauuauauaucuaugucucuacauauacacacacaccccaaaaauucuaucuaugggauagaggccacacuucaagguguacaccaaaacccuucaugggcuagcaccagccuucuaggcucggcuccugccccuccaccucaugcacucagaaugguugugaagaggcauccugcagccugcugcgcaucuucugaccccaguguuuuguugaucuugcuccucugcucauccugucaccucauauccuuuccuucauccauggacuucaaaguccaucucaaauguuauccucucugggaaucuuuccccauccucagcacagccaucauuucuuccaaugggcuuccccauucccuggugcaaacauuauuccucccuuuuagcaauaauauuauaucaucacugcuuuuguaaggagcugucuuuccugcuacaugugagauguuuguggguuagaacucagucuuagucaucguuguccucucagugccuaacaucuuucuugaagaaaauaguuaaaaguaauaagaacuuuacuauuugucacaauuauucaauacuuauauauucuugcaaucagagaguaaugcaugaaaauagcauaaauggagauggucguuuucuuuuucuaucuuuccaaucacaggcagacagcagaccuguuagccagugaaauacauugaacuaaaacggaaauucugaagggaauuugucacauuacccauauaaaucugugcaucacaaaucauguuuuucacaaagcugauacugucuuugaaucaaaaccacuuacagcacuccuguguuaaggccacgcuguuagcauuuccaugcacugugccaaauauggucgcccauccacuagugucaccugugaaauagugauugagaugugucacuuauucuagaaacuaaauaccaucugacaaaauuuaacaauuugguaaugauuuuaaacuaaaauauguuuaaguaauagaauuauugauauuuuaaauacauaguaagagagaaaaaguuaggcaaacaucugcaaggugucccuuuuuuacaugaaaaauacuccaaauguauguaucauaaaauuugcaaugcaaguauauaauuauuuuacauaaauauaaaugucuuggaaaauaucaucuauuucuaauacagacauuguccauguuugacuuuaauuuugaggaccucugaagaaaauaucugaauuuuguuuuugucacgugcauacugcuguauauguagaaacauacuugauagauauauugaguucugauaacauuuaugucaucugacuuuuuuuuaauaaagcaaaagcaaaguuucucaaaggcuuuuuucugggugcagcggcacucgucuguaaccucagcacuuugggaggcugaggugggaggaucacuugcauguaggaguucaagaccagcuugggaaacauagggagacccucucuuuacaaaacagaaaaaauuaacugggugugguggugcgcaccuguaguccuagcuacuugggagacugaggugggaggauagcuugagcccaggaggucacagcugcagugaaccaugaucauggcaccacacuccagccuaggugacagagggagacccugucucaaauaaauaaauaaauaaagguuuuugaguaaaauaacauuuccucaauuugucauauauuaaugucaauuugucauauguaaauguaauuuauuugccaaauuuuccucuuccuuuugguaaaucauauuuuuaaaaaaggaggccuaauugugaaguauuguuauuucacuauauguuauaaaauaauaaaauaugcauuauaauguaagauacugaaguucacacaaauaccuaaaucaauuaaaauaauugcccacagucugcuuugauccuuggaaucuuuauuucuauuucuuauuaauacucucaaugaugcuacuaugaugcucccucacuugcauuauuuaauuuggguucagaaauccucaugggguaaacauucauggcuucugauucccaugcagcaaagaggaaaggaugagaauuugaguaacuugcccauuggcauccagacaguugcccccaaaacugagcacugacugaguaccugcuguguacucuacugcucuaagcucuggugauaagacucaggccucuucucaaggaguuccugucuaggaagauaaauacaaugauaagggccaagcgcaguggcucaugccuguaaucccagcacuuugggaggccgaggcgggcggaucaccuaaggucaggaguuccagaccagcccggccaacauguugaaaccccgucucuauuaaaaauacaaaaaaauuagcugggcaugguggagggcgccuguaaucccagcuacucaugaggcugaggcaggagaaucacuugaacccaggaggcagagguugcagugagcugagaucacgccauugaacuccauccugggcaacaagagcaagacuccaucucuaaaacaaacaaacaaacaaacaaacaaacaacaacaacacugaaaagauaaggcauucuacuuugugcagcauacagauacacccagggugcugugauaacagagaaauugcagccauccuagaccggugauacagcuucaggggggccagggaagcccuccuggaggaggagacacuuaaaccaggcccuaaagaaugaguagaagugauccacgggaaguguggauagaggcuauguccuucagagggaggcacgccugaguacccaggggcaggacaggagauucuagagaugcaugcugugggcuuugcugccccacuuugauggaugguugggcagugcugaagagagguagcucucugugggagaaaacacacaggauucuuuuggauuaacuagacaugucagccucucuuggcaucaguuuccuccagagaaaaauauuuuuuagguuucaauaaacagaggugaaauuggccuguaagaugcucugggaucuggucucugguuaccccuucauuccauguguauaccccuguucacucugcuugagccacacaccaucaaacacaucauccuguuucagucagccuugggccuuugcacuugauguugccuuugccuggaauucugccccuccagaauauuucacaguaucuuucuuucuuucuuucuuucuuucuuucuuucuuucuuucuuucuuucuuucuuucuuucuuucuuucucaauccaaaugucaucaucuuaaaaagauuuucucugguuacauccuugaaguaucccucccuccaaguuacuuucuaucucauuauccuguuucauuuccuuauuuaucacucagauuauugauuuuuuuacauacagguuuaucaucaucuuaguucacauuacccaugugaacuccacaaggucaagacacuugucucccuugagcucacugugucccagugauuuggagagcuccuggcacauagcaggcacucaguauaggucuguucuaucaauuaauucuuuagcuaggcccauucacacuuuaugcauuuuuuuuuuuuugagauggaguuuugcucuuguuacccaggcuggagugcaguggugccaucugggcucaccgcaaccuugccucccggguucaggcaauucuccugccucagccucccgaguagcugggauuacaggcaccugucaccacggccagcuaauuuuuuaauuuuuuuguauuuucaguagagacgggguuucaccauguuggccaggcugaucucgaacuccugaccucaggugagccaccugccucggccuuccaaagugcugggguuauaggcaugagccgccacucccagccacuuuacgaauauucuugaagcugaaccaaauuaccagccauaaggagguauucauagaaaacugcuuauaauuaaaauaugaguauugaaguagauuuucaaauauaauuuuauuuuuauaaaauauaacauuuuaugauacuguauuucugacuuaaguaaccuguaccuacaaaaauucaggucguuaucacaaauacauuggggagucauuauuuguguuucaaaggaaaucccuacagaacaccaaaucagcuuuccuaguuuaucacaaucauuauccaaccgacccacaguuuugggguguucauaaagugaggcacacauggggagccgaggggagcacucaccacaguucucuucguccgccccguucccacagucauccuugccaucacagugaaaagcucgggguaagcacuugguaagauucccacagggaaaauauccuuuuuggcaugaaggagugaucaugcuaccuugagucagugcaaaaucuacaugaaagaaggggcaaaaacaaaguguuaccauggccaagcucucuccguguugucccauuuaauuuucacaagagcuauaugaguugaguucaucugguauuauucuuagugcacaguuucuuugaauaauauucucaaugacaacuuuauuuuuuauuuuuuauuuuuagacggagucuugcucuguugccaggcuggagugcacgaucucagcucacugugaccucugccucccaaauucaaacgauucuccugccucagccucccgaguagccaagauuacagacgugaaccaccacacccggcuaauuuuuguauuuuuaguagagacgggguuucaccauguuggccaggcuggucucaaacuccugaccaugugaucugcccaccuuggccucccaaagugccgggauuacaggugugagccaccucgccuggccaaugauaacauuuuaaacagccauaaucacacccaacaucagcuauaucaagaacagaauccagguucauuuugaauucacuuccacaagguaaucauaaacaaaaccagauguauuguccuagauuuguaugaaaucaaggagucauccacccuuggaaacagaaagguaaaaccaugagcuaauaaggucaaauggguagauguauuuacuuauuaaucuuuuacaagaaggacuugaggugacaugauaaaaauauaccugcaaaaggagaguuuaaguaugaguuagagagaaauccuggaacacauuagaaagaggggaacuagaauugaacauugaacacucaucuaucgugucuacugggucuacuguuugccagacacuucacacagugguuaucauuguuaaucuuucagccagccuauguaugggcgauauuauccuucauguuuugggauuagggaaguuaaauaucuugugugcagugguuugucugggaagugacacaggguggcuuugaauccucccucugaccccauaggcccacccuuagccauugcacuaugagacuaucaaucaauucaggaaucugcauuucaaggagcauaaaucaggacuaguuagaaacaaucuucuggugcaggguacauaagagaagaccaaugauaguugaauaacagcugaguugaauaagaaauuaaagaaaauaaauauaaucgacauuuacaaaaguauuauaucuauggauaggaugaccaaaacaauucuagcaauuuaaauguaagagauauucuuucaauuuugagaggauacuuuucagaaaauaaagagacauguuuuaaguuggcuaauaaaauuacagaagucauguuuuuuuuaaaaagaguccuguccaggugcaguagcucacgccuguaaucccagcacuuugaggccgagguggggaaauuacuugaggccagcaguuugagaccagccuggccaacauggugaaacccuaucucuacuaaaaauacaaaaauuagucaggcaugguggcacgugcugcaguccuagcuacucaggaggcugaggcagaagaguugcuugaacuuggggggcagagguugcagcgagccaagauggcaccacugcacuccagccuggacgacagagcuugacucagucucaaaaaaaaaaaaaaaaaauuggaacuucacagaaauugauuuaaggagaguguagacacaggaaugucuauaggucaucaugacucauugaagggaaugagggaugugggcaaagugcuccuaaccacgcacuuuggcugaaggcuagcaucaugacccagaauucccuugggcgggugugggagaugauauuuuuaacauagcagaaggauaaggaacaaacuucaguaggaacaucaucuacuuugugcugggcauuuccuaguuacuugauuugauguuaauggcaacuguguauguuuggcguuaauauccccaaauaaagaugaggaaacgacugagaacacgaaggcacgucuacuuugguucuugggaaaaugcucuugugaggccugagcccuucaagcaaaugcugccuuguagagaagccccucaggagacucuccuaaaggagguagaaccugcugcucucauuaacaaaugaugucauuuguuaaagggcagggguuggaguuuaggcaacaaagcuaugucugaauuacaaaugcacauuaagcuuuuaggaugaguagaucauuucagcuugagucauuuaguccugaugacccuggagaucccgcaagcacggaaaagcagagccucuggcccucucuggggucagccgggugugcuggugcacacuucggaggcugguguggccacaaccucugggucuuuucugacugaggaggaagacucagagcguggcuuuuggaugcuuuucugcucauuggaauuuugaucuuacaaaagcaaaaaucauuuucucugcuauugcugcaguaguggaugaaagauuuacuaccggcagcuaggcauaagaccagucaagucugugacuauuuuaggaagacuucuccacugcauggcacugggguuggcuuguuaaaccuguucacgcagggagaggcauacugugucauagauuuuaaaaucccuuaauuucuugcuuguaaagauuucuauaggagucagauuuauaaaaaugaguaguccuccuguguuuggaacaugaacgagagagucaauauaucuuugugugguggcuuagaaauuuuuuaaggcaguaauuugcaguuagaaauauauuuuauaucacaauccagcaugcacccagccguacccacgcucccaacacacaccuacacccccacacucacucucacacccacacacacuagcacacacccacgcacacucaugcccacacccacacccacauccacauaaugaaaacaaaauuucccgaaauaucacucuuuuaaaguuaugugggaugagcuuugaucauugcuauucuaucuuauucaguugagaagggaucacaugccucuaaguugauuucaugauccccuaaugggaugugacccacuauuuaaacacauucguuagugauaaugcaccucagagacacucagaccuggauuagaauucucucugccacucacuagcugugugaccucagguaagcuacuuaaccucuuuaaaucuuaguuuccucacauuuauaguagaauuaaugagagcaucucccuuguggguauguuuuggggacuagacaagcugaugcuuaugaaguggugagagugccuggcccaugguaacccuggguugaugucggcacacaggcaauuuccauacaauguaagaaaauagaauguuaagaaggaagcucuauguaaaauggaagcuugcugugccucagcauuucaugauuuuuuaugugacuucucugaaagaaauaauagggacuaaaauaaaagcuuccccuacuucuuuauguuauuccaucuuaaaagccauaucacauguaugauuuuuauuuuauuucaaaucucuuuugaaagcugaaggaggacuguaaaugauaaauaaccaaggaaaauguccuuacaaucuccuaacaauauuuucuuaauguuuagaagaagcgauuaagcauucgauuaaagagaauuuugaaauagagaggugaggcaaugugaauaggaucuuuugaagguggcaugugauguuuccuuccaggguuuauuaugaaaauaacuaugaguugcuuuuuuuuuucuucuugagauggaaucuugcccugucacccaggcuggagugcaguggcacaaucucggcucacugaaaccucccccucccggguuuaagcaauucuccugucucauccuccccaguagcugggacuacagacacacgccaccacgcccggcuauuuuuuguauauuuaguagagaugggguuucaccauaauggucaggcuggucucaaacuccugaccucaaaugauccacccgcuucggccucccaaagugcugagauugcaggugugagccacugcgcccagcugacugugaguucuuugagggcuggaccuaacuaaaugcccaucucacauaugcagaacgucuaggcggcagaggcaaacaagcaaucaauugucacaaauaaaaggcaucaagaugguuuccuuuucccuagaaaaaagauugaguugcaucuaacaaguguggacaaagaaggggaggaagagacugaacauguacgaauagaaccugccgacugcauuucuugucauuccccauuuuccaccccagaguggcaucuuccugaagacauuucaaagcacaaauuuuauguauaaggagaauaaaugaauacaauguauuccccacccuuuucucucuguggcuuccaucucuauugucuaacuuaaugucuuacuuggugcucaguaacuuuuuaagugaacaugugaauuaaugagccauuuagaaauaaaaaaaaaaggaauugaaggaagagcacuuuucaaaauuuaagcuucccaaagcagcagauuuaggcuguuauucugaugagaaauuauuuuuuagucuuccaugcacuucauuuaucauuccacucugucauuauacaaauuaaauaaaaauuaagaaccccugcuguacuugguacauagugaaaaaagaaucacuagcucucuguagaaaguguauucuguggucuauucuuccugcucucuguggaaguggaaagagacaguuuuuacugaagcuuggggauuauaaaaauggaggaugcccgcaugguagcagugcugauggcuucugcagugguuuccaugggaccucugccaaacacacagcugagaggaggcucgaacauacgacagagaauugcucaguagucacccuucuucugucuucuggucaauauucuggacgugucugugccaagagauuuuaaaaugacguuuagauggccuuuuaaagccaacuggauugcugcucaaggcuauuuuuugcuccccaucaacacuuucccuggauuauugggaaacaacaggugagaaucaucuuucagguccucaguuuaagaauugauggagauauacaagucccuuuuugcuuucucuauuucucugccaaugcuaguccuacauaaagcugaagaaagccuguauccucucagccagauguucuggcucuaacaccaggggcgauggcuccagggggguauaggccaaggaggagugcaucacgcuuagugguguuuaacaaaagucagacgaccuggucaccaaggauggcaauggugccucagaggggcuauagaaauugccggcaagccuugccaucuguuccaaagagccaacuaacugcagcaccagagggaacauucauuuagcauccagaaauguuaacuaagugccuacuaugugccgcaguuuguugucagucagcaaagcagacagcguccaucacuaccaagaacucaggggcuggcaucucugaggggggcagcagcacugucccgggcggcuccacugagaagccaaggagaaguagcuccaucagcggagugcaccuggccagagccugccccuacuucugcgaagagucaauuuuacuaaaaguccaccuuuguuggauagaugauuuguuguuuguuuggagaaaacuaggaaagucuuucuuaaaaggcuuuaaugcuaagguaggcgaagagaaauuggccucuuggugguuguuguuguuguuguuuuccaaacuuggcaaucuuacccuuucaggcaacuguuugguacuccccgccuggaugguguuucuuggccacaucaaucguuauauucagaaguuugauccaguuucauucacacauauuuaccccaccuccuuuccacuucagagauuccugcccuaauggaauuucucccaaccucuauuuucugucguguucuucugggacaaagcaaacacuucaugcugguaaaagucccucaggacccuauccacagauuuuuugggggggagggggcagaaaauauuaccccccuccuucuucagaugacugccuaauguuugaaagacagauuuggggaaaugcugccuaacuuuguggaacagaguguaggcucaauacauuuucauuuacauuggaaaaaaagagaauuucaaacugccaaccucauccuuaccagggauggaugucagccccacauccuccuugccugggugucuuuaugugggucacaaacagaaugcuguggcuguugguggguuauaagggauuuaagggaagaaggaagacuucucuuccaaaaguauuauuucugcugacugguaaacugccaaaacuccaccuuuagagaugcauucuuuuagguuaaaaucuuaccuuucaguauguaaaauucaucucguucugcaugaguugagagacuaccuucuuccuaaagccugccugaggcgagugaauggagagaaugggcaguguggugggugaaggggagaagaccauggaaagggggauugugaaggagacaggcaaggggaagcccgaugggaacuugguuugagaaauguggagagaaggugguaccuuggucccuucaccucucuuuuaauucuucucugauucauugacugcuaugucccauggaacuuucacuggcuguucuuccucugagugggaauuaucccagauucuauucccaucaacuuacgaauguaccugcaucccaggcugcaguguauguuugggcaggacccaccucacauaagcguggguaccauccacauagacugcucgugcugaguguguggaaacugcacaggacuagaccaggucccuggauucuucuuuugugaugcacaaagaaugaagaucucuugucuuuccuauaguaaagccuuccaucuauguucugugcucaccucgaccuugcuuucucagacucugcauucauuguuuccuuucuuuccuauauuguguauauauauauaauauauauguauuucuugaaauggauuuucacucuuguugccgaggcuggagugcaauggcaugaucucggcucacugcaaccuccgccuccaggguucaagugauucuccugccucagccucccaaguagccggaauuacaggcaugcgccaacacacucagcuaauuuuuuuguauuuuuaguacagaugggguuucaccaugucaaucaggcuggucuugaacuccugaccucagaugauccacccaccucagccucccaaagugcugggauuacaggcaugagccacugcacccagcuauuuucaauaucuuugucucucuauugcacagcucccaucuucaaaacaaacgagucaaccaaccuaaauccuguuauaucugccugccuguaaaacugagauauacucuccuccccuucacaauuaaauuucucagaagaaccauacaaguaagucaaugucuccacuucuuuaccacacuuucauucuuaaauccauagcuuccaucuugaccuugcugcuccgcugacauucuucucaccagaaucacugucauccauuuugacacuaaauccaauggcucuuucauaguccucaucuugcuugguuuucugcauuugacacauccaaccuuuguccccagguuaaaaacuuuuuucccuccauauuuucuaaaaauuccuuuucuuccucuuuaucuccuuaauucaucagcuccauuuucuuugucaauacacugacuaucucugacaugcguuagaucagagguuucuagauuuuugcauuucuuagaccaaauaaauucaauuaaagaauuuagagaaaccugucaaaagucacuaauguuuuaguuuguuaaauaaggaugauuuuaaaacucugaguuaccauauauuuuaacauugauuuauuagaaaaguaguauuuuaguguuaaaaauuagagagacuauaccuacagaagaaaagacaaucuuuucaaaggaauacauuuggcuuuaugaaaaauguauuccuuugaaaagauugucuuucaucuaauucaugcugaugagacggugaaacuuucauuccugacgcaauagucaggaccaguguuuugaaccaugugugagaaaacggaaaugggcaaugcaaccagaauucuuuagggagguuaguccucuguucugugacucacaaauauuuucuugcaguuugucacuuguuuuuaacuccguuuaugagaggcuccagagauggaacugccagauccugacuuuaaaauaacuaugcaaacuaaaaauagaagguaacuuacuugauuuaauuaaguguaguuaucuauaaaaccccacagcauaugagugagguuuugaaggguuucccuuugagacugaugauguccacuauuacuauaucuauucauuguuguacuggagggcuuagcuaauggaguuaaacaaggagaguaaauuaauggcauacauauuggaagagaagacauaaaacugugauuauucauaaauaauaugacugugaauauuaaaauaauaaauuauuagcauuggugaauuuugcaaaguuucuauaaagucaauuguauuuuuauauuucagccacaauuagacaaugaaacauuuuaaaaaucacaccuuuuacuacagcaugaacagggucauguauuuaggaauaagucuaacaaaaaaugggcaagacauuuauguaaaguauauacuauuagugaaagacauuacaaacauaaauaaguggaggacaauauuuuaaagauguucauucuuucccuaaaucaaucuauagauucaaagaaaucucaauaaaaaucccaggaguauguguguaggaauggauaaguugauucucaaaggcauguggaaaugcaaaagaacacgaagagccaggcuaccacugaagaaggagaacaaggagagaggacucauuaucuguauggcaagacauauuauaaugguacaauaguucaggcagugugauguugguggaaagauugaaaaauagaccaauggaacagaauagaaaguuuggaagaagacagacacauauguaaucauuuguaccacagaggagugaggcgaggugaugcucaauucuagauagauaauagguugaaauaugaaaggagaaacaauacaguuucuagaagauaacauaagaaaaaaucuuuaugacugugagauagauguauuaaggagaauacaaagaagaaaagccaaauaaaaguacuaaucauaaaggaaaagauaccuaaauuagacaauauacaaauuaagaacguccuuguauuuauuuuuuuugagauggaaucuugcugugucaccagacuggagugcaguggcacgaucuuggcccacugcaacugcugcuuccuggguucaagagauucuccugccuuagccuccugaguagcugggacuacaggugcacaacaccacgcccagcuaauuuuucuuuuucuuuuuuguauuuuaauagagaugggguuucaccauguuggccagguaggucucgaucuccugaccucgugaucugcccgccucggccucccaaagugcugggauuacaggcgagauuuuuacacagugccuggccugucuuuuaaaaaaagucaucauuaagagagugcaaagacaagcugcagaguagaggauauuugcaaagggucuguaauuaacaaacguauagguguccuacuaaucaauaaagaaaaaugaacgguaaauagaaaaaugggcaagagacuugaauagguaccgaacgaaagaggauaucugaaugacgaaaaacaucugaaaagguauuaaaucuaauucauaaucagagaaaugcaaauuaaaaccaugauaaaauaucacuaagauuacuaguauggguguaauuuaaaaauaaaaaacccaaugauacacuauuuggugaggauguaaaaucaugcaaauccucauacacugguggaguguuaauuggaacagcugcuuuggaaaacaguuuaucauuaucuacuaaguuugaaauugugcaaacccuacgagucaguagauuuacuucuagguaaaugcccauagaaauucaugcacaugugcaccaagagauucauacaagaauguucacagcagaauuauucacaauagccccaagccagaaauaauccaagugucuuugaaaaauaaaacggauaaacauuuguggaauauuucucaaugacauaccauauagucuugaaaaugagcaaacuacaacauccaaagugauuucagaucaagcagggccaguggacaguucuccuucacuuuuuacaauuaucuuguauucaguuaggaaaacauucuuugcagcucugacuuuuaagauaauuaagauacuaagauuguagcauguucuguucucuguauuuccuauuucuuugaugaucaucucagaagucauuuuugcaaaaacuuuacugagacuuuucaaaaccacuccucaguacaaacuuucccuuuuuucuacccaaaccaucuugcacauaccucuauguaauauuuauagcaugucauuauuauuauacuauuaagcuggugcaaaauaaauugugguuuuugccauuaaaaguaauggaauuuauuaauuuugauucucucaauggcuagaaaaguuuucaguucuuaguauauagcagaugccucaaaaauuguugucugaacuuaauuaacauuuuccggaauagcaaugccguuucuguaagugagccacaaagaccuaaagcuccauauguaggaguggagagcacaucagugcuucagugauaauccaugucagaagcuuaggccaaacuugggcauacaucugcugaugaugaugucaguguggguugagugcauguaauagaagcauuaugcucauuuucuuuuuuucauuuaucuuacaccaaugguucaguuuuuuuaagugaaaaacuugcuuggcaacaucuucuguuuuuuuuaagccauuuucuagggaagaggagcgguggcaaagggccucucuuaauuuuucagcuggaaucuauguaggaugggguaagguggcccauauaauuuugagaaucgggucacagcacagguaauuuucucaugcuuuauucuuuucaaaacuuacaauucacagguaaaaugaacaaaaauaacagcauguacacaacccugugcuuuuagggagggcaauuuauuuuuccaagugguuaauuuuaacuuuaguuauuacaguaagaguggcauuuuaaagugggaaacaggaaacagccaaaaaggaaauggcuucaaauaagggaacagaguuuuccuguaacacucaguguagauuauuauccuuuuccuauguauaagaaaguuuacauaacuaucaucucacccucagauugaauuuugaggcuuuuaagggaauacuuuuacaguggcucuuaaggcagaaugaaagagaaucagugucuucuacauuucuuauauaccauggguuuacaugaaaggaaauuaugaguagaaauaucuacagcaauagauauauuauuuuuuagccugugggguugaaacagaaugucccaggcaaggugugaauaacagaaaaagagagaaagaggcaaugaccuauucaaugucuacuggcugagcuauaaucgaauaaaaaauuggauaaagaaagccaggugaugaauaagaaguagaaucuggccccaaaucagaagagauucuuccuuagccauuugucuuaugaguuuauuaauuucucuuaaaggugggagugguaauuaacaucaagucugcucuauagguaaacuagcauauuaauuacaguuuuugaacuauacuauuuguuaagaaacuuuauauugauaaguagacaauguagauucagcuauucccuuaccaaauacuuaauuuguccucauugcccccaaauuuaaaacaccguuucaaguagaauuaaugugucaaacaauccaggugaauccaauuagcaauccugauacauacaaagaauauaacaaaaauuagcaucucaaagaaaaaaaagcccauguauauuuuggccaguuuuuccagguguaugauccauugaacagguuuaucagaaucaccugggcugcuuccuaaaugugcagagcccaugacccaccauagaccuauugaaucaucaggggcuggaguucuggaaucuaugucucugacaucaugacaagugguucuuggaaacucgauaauuauguaaguauuguggaugaagcggagaaguuauuugguaugccgaaggccaaacgccagucaaggucaaggcuaugacuugaacauggguuugcugaccccaaauccagcauccuuguugcucugcugccucccgucuccuaaucucuuaacguuuguguagcacuuuacuucacgacuccagaucucuggugucuguauguucacccauauccaaucuuugaaaacggacagucugaaggacaaagucuaccuucuuugcugaacuucuggaucaaggucauccauugugagaaaacccugaauaugcucucacaucauacucuuccacagacacagaaaaaacugauacuaugcuuuuucaugaaaacauuuggguuguaggagagaaagcucuccauagaacaugaauucagaaaaggccacuguugcgagaggacguaaaaccacuuguucugcagggagccgggacugcagaaacaaucgcaacuggguucaaugccaguuugagaaaggggcuuagugcagcccaacuggcagaggcugggaucugcaugaagccaagcauugggacucagccccugacaaagcaugggguauggaauaacucugaucgcccaagauugugauuuaaauaaugcuugcucauggccagcaaggaaagaaguggugauaccacugcaaaugggcaugagauuuggaacugguucacccacaggcaaaaccucugagaugcgacaguucagaccugaacacucccugggcuauguggaaguacuucugagacuacuuugaggagcugugugcaggagaaacauucuuccaacuuuaugaaaauguccagggcuccgcaaaaagggggaauucauaccugggaaagagaugauagagcuuuuuuuuuuuuuagauggagucugacucugucacccaggcuggaguaugguggcacaaucuuggcucacugcaacuuccaccuccuggguucaagcgauucuucugccuuagccucccaaguagcugggacuacaggcacgcaccaccacgucuggcuaauuuuuuguauuuuuaguagagacaggguuucaccauguuggccaggcuugucucaaacuucugaccucaggcgaucugcccaccucagccucccaaagugcugguauuacaggugugagucaccacgcccagcugauagagcuuuaaagacuauuuuaaacucugcgugauuaaaauucucaaagaacuaauggaaggaauauaucaugaaauaagaaugaaaguuuauaaaaccccaaacagacagcuuuaaacgcaguuggaaugauccaaauaaaaaauauagucacugaaaaaaaaaacaaaaacaaaccuagcaauugaauagaaaauaaacuggaaucagagaaaaggagaauuaguuaaaauuaucuuuccuucaucagacacauucuauuaacacugaauuuccuugggcaaauaaaauagccauuaugccacucgagaauaauauggcacagaacaguuggugaucuguagaggggcauggcuaauggagaucuguaccaucauagcagaaacccuuuggagagauauguugcagaauuuauaacauuuuuuagaauuuuagaaaguuaaugcacaugcuaugaacuauauaguuuccuacugaccuggggcaaaguucccuaagcaaacacaugaacauuuuucuauagcacaguguaugaaauuuuacaauaagugcauaaagaaucuaaauagcuccuggccaauucugaccagauuuuguaggcaaaggugaucaacucaguuuucugagcuuucuggauuuuagaauuguagacaaaucauuggaccuagaaaaagagagcacaccaguauugaaguaauacagagauacaauauucauuuggugguauuugggcauguauucuagcaagcaacagacauggugaccacuggucgggccaggagacugugggauagagacaaauaauagaaagaaggcaaaggccaaaaaagggagacaaagaagauccaggaagccccuggggagggagcucggcaaagacaggaggugauuagagacaggaauacuuaagggggcgaaucuagggauagauguauuccaagguggaaaugaaaagccagaugugaccaaucaggauggagcaggugugagaguuaccgagaaugggauguagccaggacaaaggcagaguuggaggauaugggaacucagagagcaagagagcugaagagcaggcccaaggugagcagaagggagauuucagaggugaggacagcaagaagauagggauggggguaggagggcgagacaugaaaauggagaaaagacaggccgggagagcaucugagacagaugccugcagaggcagggaggaggggagaauaaauaaagaugggaaggagaggcgagaggcuugaacaggagcaagggggcccgagucagaacagugggaagggggaggaugggaaaggaggacuagaacuuuaucaaucacauugaacauguuguaaaggcuuuuuacuuuguaauaaaguuaaauuuucaaucgcaauucuuuaauuuuuuuuuuuuuaauuuugagacagagucucgcucugucgcccaggcuggaguacaguggcgcagucucggcucacugcaaccuccgccucucagguucaagcaaucuucuugccucagccucccgaguagcugggaccacaggugugcaccaccaugccugccugauuuuuguauuuuuaauagagaugggauuucaccauguuuuccaggcuggucuugaauuccugacuucagugaucugcuugccucccaaagugcuaggauuacaggugugagccacugcguauggccucaaucucaauucuuuuuacaucuuaaaacacucaaaagucuguuuaucacaugacuguugaaucagcuguuuuauuuucgcuucggagcacuuuucugauaacaacauugaccuucacugcaaacuuaauuuuuuaaaauacaugcaaaaaccuggaaguacgggugaguaaagcauaugagagguuuauuuuuuguuuuuagauaauuaggccucuaaugccacuacuacuucacaugugaaacaagcacacucauuuuacccaaagaauguuguuauauguuuaccaaauaaauaaaccaagccauucugggcucuuaaauagauauguacugcuaaaaauuaguugcauuuuuuguugcauaacuauuuauacaaaaucauucuuugcuaauugaauuuuauuugguuuacuauauuccagaauaaaaaugugccauuuuucgauaccaaccuauuagaaagcagcaucccaauuuugccucuaaaauucacauggcaggcaauuuugucacuucaagugagaggccuuaaaacucuuugauuacaucuggucauauuuauucacaguaagaugaacacacgaguaagcaucuguugugagauguauuuagcuggcgucuucagagauaacacaucucuaaagguuuuaacucccauguucccaaucuuuuuccuccucccucacagugggcuucauucagcccgcaagcaggucagucuucgggaugacuggccugaaacauaauugauuuucacaacuauccacagcaugaauauaaaguugugaaauuaaaauucagauggaaaaccuuuucucaagucagaguggccaagugaaacugacauccguaagaaaggaccaugccaggcaugccuugagucuggccacuagggggcagucaaacacugcuccccucaaaauacuguucgggcccgguuuugguuaaccuauuuuggagguuaagcaaauuauuuaaguagcaauugguaguugccaaguagcagccucaaugcuucaugcuuuuacuuucuuacauaagcccauguuuuugauuuguaauaugguuccuaauuuguccauuaagaaauguuuuuuaaaaguuuaaaguuauguuuaauaacuuuauuuuagagauguuuacucuuagagacagauacuguuuuuagaucugccuguggcuuuggaguucccagucuaauuacguuaacgcaagauaguuacuaacaauuacaugaauuuuauggacauauuucaacagguugaaauuccacaaaacacaauugguaguuaccaaguagcagucucaauacuucaugcuuuuaauuuccuacauaagcccauguuuuugauauguaauaugguuccuaauuuguccauuaagaaauguuuuuuaaaaaguaguuugaagcugguuaacagagauacacagugaauaaauuaaugauaaaacacacguaauaauaauaagauacauuaugcauaguugucuguuagugccuguagcuuaaggcaaucacucauuccuuaggcacuccagagugaugauggucagagaagaaaagacgaucacauaauuucuaauuuuauguuuuguuuagaucuggccuaagagucuaucacaaauauuauuuaaauuaaaaagacaaccuuuacucuuaggcaacucuaaaugagcuuucuuugguuacuaugaaaagccuuaccguuuuaauuguccacaauuuuguugugaaaaagaaaagaguuuuacuaauuauagagcaaauucuauuauuuuuauaaguaggaauaaaaugucaaagcauugauuaaugugucuugcuuugaaaagaaaucauuuuaaacauaaagguuuaaauuaguagucaaaaguaauauaaaauuagaaaauaaaaauuuccaggauuauaaucaauaaauauuuguuagguugguacuaggaguuugaaauauggcuuuuacuuagaaauaaaaucaaacaaaaauuauuaauugaacuuuuuuuuaguuuaaagggugacuuuacauuaugguaaaucacaaaauguuauuuuaguaauagauguuuuucaucucauaaacgguuuaagcaaaaucaauuaaaugcauuauguauaaaagcaaaaguauaguaaaauugguuaaacugugguuauagucccguacauuaaagaacuuuuuaagggcacagaugagcucuaugacaugucuuaagaaccugcuuuguagcuguauauucuuaaaauuguauaaaauugaauauucaaauguggauagaacaugaacuucugaaguaggaccuuaaauauagaaauagacugcuuguugcaacuguacugcaugcaaggugaguucauauauuguuucuucuuaguuaauccuuagcuuuucauguaagagauauuaaaauauaaaauaaaagucaugcuaggugcauggagauauagauuuuaaauauuuguaguaaaguuuuaguauuauuuuaaauucaaaauaaaauuuagauauuuuaagccuuuuaaaaaucuuuuguuuguuagaaguuuuaaaauaauuccucauaaguauugcauuuuauuucaagauuuaaaauauucacuuggaauucaccuaauaaaacugaauauuuaaaaaaccuaaaacgaauuucucagaaaauaaaaauaauuucaaauuuuaaccuuuauucucagagguuuaucaaaauucuuuaagaaaaaauacaaauuaaaauagaaacauuuuugaauaauaauaaaccccagcaaaucuugggugugguuaauagguuguuuaugaauguauaggcugacaacguaucuuuuuauuuaaaaacaagugaagauuuagguuuuauuuuuuggugagcuuuacaaugaaaaugguacugacuugaaacuuaagaguuugacugaaauaaaaauuuccacaaauuaaaaacaaaagaaaauuaucuaaguaaaugcacuuguauagacuuuuaauaacuuuauuuuagagagguuuacucuuagagacagauacuguuuuuuagaucugccuguggcuuuggaguucccaguuuaauuauguucacgcaagauaguuacuaauaauuacuugaauuuuaugggcauauuucaacagguugaaauuccacaaaacacaauuuuaguuuauuaauuugucacacuuuucagaacaaaugccaaaaauguuuucuauguuuuaauugauauagucaacauuguuuuuugacauauuuuaucuacagcuuuaauaacauacaaaggcuuguuuccaugaaaaauuuguugcaucuaaaaauuacuaggcugugugggacuacaagcaaugaaagauaaugacaaauaccaggcaaauuugaugucuguuuuuuuuuuaaacaccccaauauauuuauuacaacugccauagaacuacauagaaauguauuuuuugggaauugcacucauuuaaaacgagaaaguagcaaccuuaccuuugacauugaucagaacgaugaaaugaaguagaaagaacauuguaaucaaucugaggcugaagagauguuuaaaaaccagaaaaacaaucauagguuuacagcaauugaguuauuagacguauccucuuauaccucagcaggaguucugauguaguaaguuca

SEQ ID NO: 191582 - RNA, 84193 nt, Homo sapiens
guggcgcgagcuucugaaacuaggcggcagaggcggagccgcuguggcacugcugcgccucugcugcgccucgggugucuuuugcggcggugggucgccgccgggagaagcgugaggggacagauuugugaccggcgcgguuuuugucagcuuacuccggccaaaaaagaacugcaccucuggagcggguuagugguggugguaguggguugggacgagcgcgucuuccgcagucccaguccagcguggcgggggagcgccucacgccccgggucgcugccgcggcuucuugcccuuuugucucugccaacccccacccaugccugagagaaagguccuugcccgaaggcagauuuucgccaagcaaauucgagccccgccccuucccugggucuccauuucccgccuccggcccggccuuugggcuccgccuucagcucaagacuuaacuucccucccagcugucccagaugacgccaucugaaauuucuuggaaacacgaucacuuuaacggaauauugcuguuuuggggaaguguuuuacagcugcugggcacgcuguauuugccuuacuuaagccccugguaauugcuguauuccgaagacaugcugaugggaauuaccaggcggcguuggucucuaacuggagcccucuguccccacuagccacgcgucacugguuagcgugauugaaacuaaaucguaugaaaauccucuucucuagucgcacuagccacguuucgagugcuuaauguggcuaguggcaccgguuuggacagcacagcuguaaaauguucccauccucacaguaagcuguuaccguuccaggagaugggacugaauuagaauucaaacaaauuuuccagcgcuucugaguuuuaccucagucacauaauaaggaaugcaucccuguguaagugcauuuuggucuucuguuuugcagacuuauuuaccaagcauuggaggaauaucguagguaaaaaugccuauuggauccaaagagaggccaacauuuuuugaaauuuuuaagacacgcugcaacaaagcagguauugacaaauuuuauauaacuuuauaaauuacaccgagaaaguguuuucuaaaaaaugcuugcuaaaaacccaguacgucacaguguugcuuagaaccauaaacuguuccuuauguguguauaaauccaguuaacaacauaaucaucguuugcagguuaaccacaugauaaauauagaacgucuaguggauaaagaggaaacuggccccuugacuagcaguaggaacaauuacuaacaaaucagaagcauuaauguuacuuuauggcagaaguuguccaacuuuuugguuucaguacuccuuauacucuuaaaaaugaucuaggacccccggagugcuuuuguuuauguagcuuaccauauuagaaauuuaaaacuaagaauuuaaggcugggcgugguggcucacgccuguaaucccagcacuuugggaggccgaggugggcggaucacuugaggccagaaguuugagaccagccuggccaacauggugaaacccuaucucuacuaaaaauacaaaaaaugugcugcgugugguggugcgugccuguaaucccagcuacacgggagguggaggcaggagaaucgcuugaacccuggaggcagagguugcagugagccaagaucaugccacugcacucuagccugggccacauagcaugacucugucucaaaacaaacaaacaaacaaaaaacuaagaauuuaaaguuaauuuacuuaaaaauaaugaaagcuaacccauugcauauuaucacaacauucuuaggaaaaauaacuuuuugaaaacaagugaguggaauaguuuuuacauuuuugcaguucucuuuaaugucuggcuaaauagagauagcuggauucacuuaucugugucuaaucuguuauuuugguagaaguaugugaaaaaaaauuaaccucacguugaaaaaaggaauauuuuaauaguuuucaguuacuuuuugguauuuuuccuuguacuuugcauagauuuuucaaagaucuaauagauauaccauaggucuuucccaugucgcaacaucaugcagugauuauuuggaagauagugguguucugaauuauacaaaguuuccaaauauugauaaauugcauuaaacuauuuuaaaaaucucauucauuaauaccaccauggaugucagaaaagucuuuuaagauuggguagaaaugagccacuggaaauucuaauuuucauuugaaaguucacauuuugucauugacaacaaacuguuuuccuugcagcaacaagaucacuucauugauuugugagaaaaugucuaccaaauuauuuaaguugaaauaacuuugucagcuguucuuucaaguaaaaaugacuuuucauugaaaaaauugcuuguucagaucacagcucaacaugagugcuuuucuaggcaguauuguacuucaguaugcagaagugcuuuauguaugcuuccuauuuugucagagauuauuaaaagaagugcuaaagcauugagcuucgaaauuaauuuuuacugcuucauuaggacauucuuacauuaaacuggcauuauuauuacuauuauuuuuaacaaggacacucagugguaaggaauauaauggcuacuaguauuaguuuggugccacugccauaacucaugcaaaugugccagcaguuuuacccagcaucaucuuugcacuguugauacaaaugucaacaucaugaaaaagggaaaugauuccauagcguuauuaugaaaguaguuuugaacuguaaugguagaggaugaauagcucacaauacaaauuugucauuucccuuuaagagagaauucccauuuuaugugagaguccacauguuccucauacccauaguuugccacaucuugaguacucuucagaauuauuugaauuuuuugaauuuuaucuguggaauguauuuuuuuuuuuuucuuuuuugagacacagucuugcucuguugcccaggcuggaaugcaguggcgugaucucggcucacugcaaccaccgccuccuggguucaagugauucuccuguggcagccuccggaguagcugggacuacaggcgugugccaccaugcuuggcuaauuuuuuguguuuuuaguaaagaugggguuucaacguguuagcaagguuggucucgaucugaccucgugaucugcucgccucagccucccaaaguguugggauuacaggcgugagcccccgcaccuggccgaauuuuaucguggaauguauucuuaaugugaauaguuuuugauuccgaaccaugaauaauaagaaaauaaauaaaauuuaaaugaaaauaaaagcuaauauauacagcuuuuaauaauauaguuaaaugccaucuuguaacuuuugugaacucuuguuacaccuuucuauagauucgcaagagaauggauuaaugaucuuguuuaauuaauaugccuuaacaaaaguaauccauagucaagaucuuaagcauuuuuuuccuuaugaucuuuaacuguucugggucacaaauuugucugucacugguuaaaacuaaggugggauuuuuuuuuuaaauagauuuaggaccaauaagucuuaauugguuugaagaacuuucuucagaagcuccacccuauaauucugaaccugcagaagaaucugaacauaaaaacaacaauuacgaaccaaaccuauuuaaaacuccacaaaggaaaccaucuuauaaucagcuggcuucaacuccaauaauauucaaagagcaagggcugacucugccgcuguaccaaucuccuguaaaagaauuagauaaauucaaauuagacuuagguaaguaaugcaauaugguagacuggggagaacuacaaacuaggaauuuaggcaaaccuguguuaaaaucuuagcucauucauuaauugugucaugcugggcaaaucagucucucuggccucuuuuuccucacucgaaaaauggagacgaugaaaauaaugucucauagguuuggauuaaauuaaauaauguagguacuuaguaaauguucucuuucaucccuccuuugauaaauuugccaacugagauuugcugaauuacgucuuucuuaugccaaaaaaaccuaggacuuguuuugauguuaauuaaacuaaacuauauuucugcaagcuaucacagaggacagagauuauuuuaccgauauacuauaaguaucaugauuuggaaggaguuucccuggcguaggugccgcauguuucuaagcaauuauguaauaagauuauauauucagucauucaaauaauuauuaccuacuugacauaaguaaugaacuuucccuuuucuucagaguguuaaucucuaguaaggggaauaaagaguacacagauaaaguauaguguaagguugaauguaguaugugcuaagagaaaaauauaaaaaaguauaaugagaguugagaagaaagagcaaauaguauugggcaaaguuaggcaauuauuccuuugagcuaaaccuugaaggauaggugagagauuaagaaauuugaagaugugguagagugauaauguucuaggcagagggaacaacaugaggaagaauauguaguguguucaggaaauagcaaguaauucagguuggcuuugguuguuuugugucugaaagggaccaauagacaaggcaaaaaggcagacuaaaggcaggcauugaaugccaagcuaaagaaauugaauuuguuugguugguuggugagcagagaaaucacaugcaaauuucaucaugcuacuuauugugucaaaccuuagaucaccucccuuuguccuuauagcaaaaucuaaacuugauauggcuuucaaguuccuuugugaucaggccccugauuuacacucuuggcucagcuugccauauucauccucucaccuaucuucauuugccauucauuccuacugaauuucuuuucguuaccaaaaccacaaugcucucuggcucuuuauuaaacauauuguuaccucuacccacaaccuacuuuuucccuacuuuuugucuagcuaauuugcgugcucgucuuucagaucuuggcuuauuucugcuucugagaaauacuuccugucugcccucguugagcuucuagugaaggagacauacauaagcaauuauagugugauacaugcuuugaaagaaauucauggcuauagggagugcauauacaaagggaauauagguaaugggcaaauauuuacauguauguuauuggauaccaaaugguauacauaggauucaguaaauauuuguagagugaguauuaguauuauuugcuuuagaaagccuaaugaucaaacagcagucuuuggagauaacguuuuucaaaaugucaugucugugccauuagaaucuucuagacugcucauugaaaggacagauuccaggccccacucugaaucucuuaauuuauaauuuuuggaaaugaugcccaugagucuacauuuuaaacuaccugaaugaucccuauagaaagagaaaacuggagguaggaagaucaguuaggggauguguaauggucuaggugauagagacaagugccugaauuacaguaauaacagugaaaguaaauauggaacauaaaacuauaggaccuugcaguagucuagauauggaggauucaaaaaaaggaacaaaugacagggcaaagcauaugcagaacacaguaguaacagucauagaaauggauaagggagucauccauucugcaaauacuuagugcuuacuugugucuggcaaccugcucggcauuaaggauacaaauaugaauaagauguccuuugaccucuaaguacucagucucguaagcacgucuuguaagcacaucuugguugcuuccauaaaaauaaauacacuagugugauauguuauaagagcauguaccaagugcaugaaaagugagcagccaucucugguuggucagaaaaagcuccauaaagcaguuuuugcugaaucuugaaagauauaccuaaggucaaaugguuaauucuuuaaucauaaccugcuagaauugaucuauaaccaaggaaggauaguaaggaauuaauaaggccacucucaacucacugcaaaggaguuaacuuuuugaaggcuguaauacauaaaucugcugacuagucucuugagaccuuuugcuuuuacguuuacuuuagauucaguauugaaaaguaagaguaauggacuuaagcuguguuuuucaaccuguuuuguucaguucuaacauguaauauuuuuuaaaaaauuauuccuaaaguucuaugaggaauugugcuguuucugccucucagcaguccuuccuuuugcauuaaaucauaggcauuucuguuaccauucuucagcuuauuaaugagauccucagguuauuugggaaauguuuauuugguaauuaacucuuuuucaccuaguucauuuuuuuaacuuuuuuuuuuaaauagccgaguuucuuuucauugcugaacuaaaauggauguguuauuauuagcugaacuccuuaguuuacuuuagaguucacccuuuguaugguucuauggauuuugacaaauuguauaaugucguauaucugccauuauggcauuauacagaauaauuuugcugcccuaaaaaucucccgaguuccaccugcucacccaucccuccuccugagccccuggcagccacugaucuuuuuacugucuguauaguuuugccuuuuccagaaugucauguaguuggaaucauacagaauauagcauuuucagacuggcuucuuucacuuagcaauaugccgagaccagcucgauuguagagacccuaacccagcggcacuagaggaauuaaaggcacacagaaauauagcgguguggagugggaaaucaggggucucacagccuuuugacagcaagccagugauaagcauuguuucuauagauuauagauuaacugaaaguauuccuuaggggaaauaaagggcugggccgaaguaaagggaugggucuggcuaguuaucugcagcaggagaauguccuuaaggcacaggucgcucaugauaguuugugguuuaagaacgccuuuaagcgguuuucugccccgggugggccagguguuccuugcccucauuccgguaaacccacaagcuuccagcgugggugucauggccaucacgaacaugucacagugcugcagagauuuuguuuauggccaguuuuggggccaguucccaacagcaauauguguuuaagguucuuccaugucuuuuaaugauuucaugcugaauaauauuccaucguauugauguaccacagcuuguuuauccauucaucuauugaaggacaucuugauugcuuccaaauuuuggcaauuaugaauaaagcugguauaaauauucacauacagguuugugugugaauauauuuucaacucauuuugguucacaccaaagagcacgauugugggaucauauaguaagaguauguuuaguuuuaugagaaacuacaagcuuucuuccaaaguagcuguugcauuuuguauucccaccagcagugaaugagaguucuuguugcucacauccucaccagcauuuggugugucaguguuuugaauucuagccauucuaacaaguguguagugguaccucauuguuuguuuuauuuaauuuuuuuuuuuuuuuuuuggagaugaaaucucgcuuugucgcccaggcuggagugcaguggcgugaucuuggcucacugcaagcuccgccucccagguucacgccauucuccugccuuagccuccugaguagcugggacuacaggcacccgccaccacaccuggcugauuuuuuuguauuuuuaguagagacgggguuucacuguguuagccaggauggucuugaucuccugaccucgugauccgcucgccucggccucccaaagugcugggauuacaggcgugagccaucaugcccggccuguuuuauuuuuuaaagucaauuuucuuucaagaauuagcuacuuuuuaguaucuuuaauuaaaaaucucauuagagaaggagguuggauauuuuguugaagugggguuuuuaaguuacacauccauuugcuuuauuagugauuaugucuaguccauguuaacuugaaaaaugagacuauaaugagacauuuuauuuaggcugcuacaaacaguuuuaaauuuggucuucacuuuauuuuaguaacauugauagagcuuauuuuucccaaaagcuaaguuagagauuauaggaccaaccgaagcaacuauuuucuaagaguaauaauaagugacucaggugccaaauuuguaguuaccaucaacuauuggaaccauaugaguacuuaaugcccuggagagucaaauauaaucuacucuaauacagaaaauagaaauauugaaaaacuguaaauuggauuucauauuguuaaagccaccuauagcuuuagaaacucugaacauuauuuucuuagaaaauggauguguucaauaagaauagaaauuauguauuacugucugcaacucacuuugucuaauuauauccaauuuauucauccagucaauauuucaggagugacuaauauaccagacauuuuuguaguugcuagggauacagugacaaauaagacaaaaucucuaccucagauugcucacagccuaguagggggaaaaagaacaguguaugaucaaacucuucagggaacacauaggggggcaaacacuuaaucuuaccuuagggaucacuacaguuuucuggaggagguaguuucuaaauggaagccugaaagaguuguuccaggucaagaaaagcaaagaaggggaaacagcuuguacaaaguccuagagguuaaagaaaacauucuuucaggauaugcaaaugguuggguauggguaaaaaguagacuguaaaagaauggcaucauaaaaauuaaguaaauugucacauaaauauauauauuucuuauguacccacaaaaauuaaaaaugaagaaauuaaguaaauugugaaaggccuucauacuauggaguuugacuugaucuugaaaaguaagaucuugaaagguuuuuagcacaagugauauugucagaucugguacauugguagguuuucaguaaaugucuucccuuacuccuuuuuucucuuuccuucugcuuuuguuuaaagcgacaagauguugcucuuuucccaggcuggaauacaguggcaugaucauagcucaagcuccugggcucaagugauccucccgccucagccucucaaguagcuaggacuacaggcauaucaccacaccagcguuuucuuuguagaggcagagucucacucuguugcucaggcagguguugaacuccugccucaagcaauccucccaccucagccucccagagcccucaaauuauaagccacugugcucggggcauccuuuuugggggguaaucagcaaacugaaaaaccucuucuuacaacucccuauacauucucauucccaguauagaggagacuuuuuguuuuuaaacacuuccaaagaaugcaaauuuauaauccagaguauauacauucucacugaauuauuguacuguuucaggaaggaauguucccaauaguagacauaaaagucuucgcacagugaaaacuaaaauggaucaagcagaugauguuuccuguccacuucuaaauucuugucuuagugaaagguaugaugaagcuauuauauuaaaauauuuaaaugaaacauuuuccuacauauauuuguucuauaaagaugaaucugauuuuuaugcuaauauuuuggcuaagagccugguagaagaucuuacauuuuuaaauaaucuuuuagguugaguccuuuaauagaauaguuuuuacauuagaaacauguaaguuguuguucuugugauguugaauuggcugguuuucuguauauucugugauuuuuuaaguaacaaaaauaacaguggugaaaagcaguaagucaguccuugaauuaucaauuuaaaauaaauuguguacuuuucaucuuuggagagaauaugauuuacuuuacaaauuuuuuuuuuguuuuuuuuuuuuuugagauggagucucugucacccaggcuguagugcaguggugcgaucucagcucacugcaagcuccgccucccggguucacgccauucuccugccucagccucccaaguagcugggacuacaggcgcccgccaccaugcccggcuaauuuuuuguauuuuuaguagagacgggguuucaccguguuagcuaggauggucucgauuuccugaccucgugauccgcccgccucagccucccagacugcugggauuacaggcgugaaccacugugcccggccuacuuuacaaaauuuuugaguuuaaaauacacgguuuccagcagcugaaauuugugaguacauauguguuggcauuuuaaacaucacuugaugauuauuuaaugcuucaugagagauuuacuuuuuaaaauguaauauaaaauaucuaaaaguaguauuccaacaauuuauaugaaugagaaucuucuuuuaaaaauaagauaaacuaguuuuugccaguuuuuuaaaauaaccuaagggauuugcuuuguuuuauuuuaguccuguuguucuacaauguacacauguaacaccacaaagagauaagucagguaugauuaaaaacaaugcuuuuuauucuuagaauacuagaaauguuaauaaaaauaaaacuuaacaauuuuccccuuuuuuuacccccagugguaugugggaguuuguuucauacaccaaaguuugugaagguaaauauucuaccugguuuauuuuuaugacuuaguaauugagaauuugacaauagcguuauaccuuugcccugagauuuacaaaucuguaccuagcauucugccucauacaggcaauucaguaaacguuaagugaaauaaagagugaaugaaaaaauaauauccuuaaugaucagggcauuucuauaaaaaauaaacuauuuucuuuccucccagggucgucagacaccaaaacauauuucugaaagucuaggagcugagguggauccugauaugucuuggucaaguucuuuagcuacaccacccacccuuaguucuacugugcucauagguaauaauagcaaauguguauuuacaagaaagagcagaugagguugauaauugucaucucuaauacuucuguuaaaaggaaauaugaaaagaaaauauuagauaaugucuuugauaaguguguuaguaacugacaauaauuuuauucuauuaaguguagauuggaauaaauacaaauacauuuagugguaguccaguggugucaagcauuauguuuuaguacgaugugauuaacguagaauagcuuacaaauauuccuuuacuggccuauauaagcguuuaagaggcaguauuuggugugacugaauucuuuuuacaaaugauugugguaauuggggcauuaaagcagcauuaaauaagcuuuuguuuucucuacuuaaauguguucuaaggucuguauugccaguaguacugaauugaggucuuaaauuccacaaguguaauuacacaacuaugugauaaacugcaauauuuauccauucauuaaacuguaaacucuuugcagucucaccacaguuucucuuacuaggaucuagaaauauuuccuauuguaggcugguugcaguggcucacgccuguaaucccaacacuuugggaggcugagaaggguggaucacgugaggccaggaguuugagagcagccuguacaacguggugaaacccugucucuacuaaaaauaaaaaaauuggccaggugugguaacacacaccuguaaucccagcuaccugggggcugaggcaugggaauugcuugaaccugggaggcagagggugcagugagccgagauugugccacugcacuccagccugggugacagggaggcugaggugggaggaucacgaggucaggagaucgagaccauccuggcuaacguggugaaacccugucucuauuaaaauagaaaaaauuagcugggcgugguggcagacaccuguagucccagcuacucaggaggcugaggcaggagaauggcaugaacccgggaggcggaucuuguagugaucugagaucaucacgccacugcacuccagccugggcaacagagcaagacucugucucaaaaaaaaaaaaaaauccuguuauaaaacuacuuaaaaaucucugaguagcugagauuuggcuaaucaugacuuaguauuugaaaaguugugacuauuuuuuuuuuuuuuaauugagacaagguucuucucuguugcccaggcuggagugcaguggcaccgucgcaguucacugcagccucaaccucccaggcucaauuaaucuuucuuccucuuagccuuccaaguaucugggacuacagguaccaugccaccaguauacuaccaguccuggcuaauuuuuuuuguauuuuuuguagagaugggucccgccauguugcccacacuugucucaaauuccugagcucaagcagccaccacacccaccugugaccauucuuuuuuauuuuuaugagauaauaaacauacaaguuuaaagaaaugucuguacauaaaugugauuauaguacaaacaaguauuuggaaguucaucuaaacaaaugcaucacaguuuauaggcaaaacaugaaagauuggauaauaaugggaaaaaaaguaaauauucaccaacauucuuucucuuuuuucuuuuucguuuuuuuuuuuuuugaggcggagucuugcccuuuugcccaggcuggaguacaguggcaccaucucggcucacagcaaccucugccuucuggguucaggcgauucuccugccuuagacucccgaguagcugggauuacaggcacccaccaccacgccugacuaauuuuuguauuuuuaguggagaggagguuucacuggguuggccaggguggucuugaacuccugaccucaagugauucguuugucucagccacauuuuuuuugucuaagaagauacugggccagaucauuguuucucaaauugcagauuaugaccuguucauaguugugaaacuuauuuugugagucguauaugcucuuuuuaaaugaaaugaaaauucugaguacaucacauguaguuaggguuuagaaaauaaaaaauacaauauaucuaguuaaauuuggacuucagguaaacagcgaauaauuuugagauauacuuaacacuaaaaaauuauucauuguuuaucugaaauucaaauuuaaugagguguccuguauuuuauccagaaguccuacacacaguaaaguuuguuuuguaaaacuuuuuuacuuaaccuuugugugcccaugugugugugcagucauaaaguguguguguguguguguauuuaaaaaacuagguuguacucaaagccugagcuuaauuuauucccaaaccaguauuacauuuuguuuauucuagcaaaauagcauucuguuuugauuccucuuuagcugggaguaaguuaacccuauucuguugcuuagaugaaauaauauggauaaaaucauuuugaaaauauguauuuaauauauaguaugccuuuaggcuguaguguugucuaaaugaaugcuaaagucuccaagcuuuagcuuuuaagucauaaccucacagcaucaucugacuuuccaacucauuguggacaguauuaccauaaaguaaugaucaccaagccauaucuuaccaccuugugaguaguacuaaggaaguaaguauaguuuauucacuguguugauugaccuuucuaauuacuauacuuaaguacuugaaucaauucauuuuguuucaaaugugucauguaaucaaauaguagaugugcuuuuugaugucugacaaaaaauaaguuuuugcauucuagugauaauauacaauacacauaaauuuuuaucuuacagucagaaaugaagaagcaucugaaacuguauuuccucaugauacuacugcuguaaguaaauaugacauugauuagacuguugaaauugcuaacaauuuuggaaugccuuguuaaauuauuuaucuuacauuuuuaauuuccuaaucuguaauuuaucuaagccuuugagaaagucucuaaaccugguccuauaugugauuuuaacuuccugugaaacucugcugucucucuguuaaaguugcauauauacaauauauaccguaguccccuauucaugggguauacauuccaauaucccccagugaaugcuugaaaccuuagauaguaccgaacccuauauauauauauuaaaaauguguaguauuuauauauauauaccuauaaucuuuuuuucuauaagcacauacccugugauaaaguuuaauucauaaauuaggcacaguaagagauuaacaagaacuaauaauaaaauaggacaauuauaacaaaauaccguaauaaaaguuaugugaauguugucucucugucucaaaauaucuuauuguucuguacucauguggcagcagcuucaucagcagauguggccucuccaguaauuuuuauauuuuucaguccaaaccuauucuugaaucuguguaaccaaccaucccuuacuugcaguaaauggcuuggugucauucauuucaggggaucccuuacugaaguuuucguuuaggcucuaugcuuucuggcguaauauguagcugucaaucaaaacaaccuguucauguuuucuacccacaaauguaauaccuuuucuacuucuauggugcacuguguggccacaacauuugcaguuugaggugugacagcaaaaccagcucauaugucuuucuccuucacaaucucacagauagauuuguucuuaccauagaugucgcaguacaauuuuuuuccuuuccuuaagucgagaacuuucacuguuucaauuaaaggaagcacuuuauggcuucuuuuuggcauauuugaauugccagcaucauuauacuugugcuuuggggccauuguuaaguaaaauaagggugacuugaacacaagcacugugguaccacaauagccgaucugauaaccaagacaacuacuaagugacuaauagguggguaccauauacagccuggauacgcuggacaaagggaugauucaugucccaagugggauggagcaagauggugcaaguuuuuuuuucuccauuuccauuuuccuuuccuaagauuuccacauccuaguggugcaagauuucaucacacuacucaggaugacacacaauuuaaaacuuacuaauugcuuacuucuggaauuuuccauuaaaaauuuuuggaccuagguugauugcagauaacugaaaucaccaaaagugaaaccauggauaaggggggacuacuacuauaugugcauugagaguuuuuauacuagugauuuuaaacuauaauuuuugcagaaugugaaaagcuauuuuuccaaucaugaugaaagucugaagaaaaaugauagauuuaucgcuucugugacagacagugaaaacacaaaucaaagagaagcugcaagucaugguaaguccucuguuuaguugaacuacagguuuuuuuguuguuguuguuuugauuuuuuuuuuuugagguggagucuugcucugucacccgugaucucgguuuaccgcaaccucugccucccgugcucaagcgauccugccucagcuugccaaguagcugagauuacaagcaugcaccaccaugcccaacuauuguauuuuuaguagagauggcauuucaccauguuggccaggcuggucucaaauggucgugagccaccaugcccagccugaacuacucuuuuuaauuggcaccauugaaggauugcuccucuuuucuuaaagagaaaauauauuaccuuuccuuucuugacuacugaaguaguauuuuaucucaaaguauugagaguagaaacuaacuuggugugccugugaucccagcuacucaggaggcugaggugggaggaucgcuuaagcccaggcggucaagguugcagugagcugugugugugccacugcacucccaccugggcaacagagugagaccgugucucaauggaaaaaaagagaaacuaauuugauuucgaugacaguauuuaaauacuguguaagacaguacuauuuaauaugugguugugacacaaaaacaaagccuauugaaaauuuucagagacaauaagauauauaauuaacaaaaucugagcuuuuuuuuuuucuaauuagaaaguaaaugugguuuagauauaccauaguuuaccuaaucaggucauggaauauugcauuuuucuuaguauguguguaugucuguauaacuguguaggauuugauaucuguuuuugucugugugguaucauguacguauguauaugcauauguaaaaucagauuuacccuuguuauagggccacagaauugauuuggaacaucuguuuugauaggucuuagaauauuuaauuguauauauaguaagauuaggugaguuuuaauuguguagaacugcuaaagaaagguuuuuagggauuguuguaugaauaaaaggcuuuagguucauuggaaucaggggaaucaggcuuuacuagaagaacaggagaaggggugacugaccgaaaaauaaaaugccaaguacucagaauaacccuuuaaauacugauauguaauauuuagcacauucuacauaaacuguuucuaugagaaagguugugagaauaauauaaauuauauggcuuauaaaauauuaaugugcuucuguuuuauacuuuaacaggauuuggaaaaacaucagggaauucauuuaaaguaaauagcugcaaagaccacauuggaaagucaaugccaaauguccuagaagaugaaguauaugaaacaguuguagauaccucugaagaagauaguuuuucauuauguuuuucuaaauguagaacaaaaaaucuacaaaaaguaagaacuagcaagacuaggaaaaaaauuuuccaugaagcaaacgcugaugaaugugaaaaaucuaaaaaccaagugaaagaaaaauacucauuuguaucugaaguggaaccaaaugauacugauccauuagauucaaauguagcaaaucagaagcccuuugagaguggaagugacaaaaucuccaaggaaguuguaccgucuuuggccugugaauggucucaacuaacccuuucaggucuaaauggagcccagauggagaaaauaccccuauugcauauuucuucaugugaccaaaauauuucagaaaaagaccuauuagacacagagaacaaaagaaagaaagauuuucuuacuucagagaauucuuugccacguauuucuagccuaccaaaaucagagaagccauuaaaugaggaaacagugguaaauaagagagaugaagagcagcaucuugaaucucauacagacugcauucuugcaguaaagcaggcaauaucuggaacuucuccaguggcuucuucauuucaggguaucaaaaagucuauauucagaauaagagaaucaccuaaagagacuuucaaugcaaguuuuucaggucauaugacugauccaaacuuuaaaaaagaaacugaagccucugaaaguggacuggaaauacauacuguuugcucacagaaggaggacuccuuauguccaaauuuaauugauaauggaagcuggccagccaccaccacacagaauucuguagcuuugaagaaugcagguuuaauauccacuuugaaaaagaaaacaaauaaguuuauuuaugcuauacaugaugaaacaucuuauaaaggaaaaaaaauaccgaaagaccaaaaaucagaacuaauuaacuguucagcccaguuugaagcaaaugcuuuugaagcaccacuuacauuugcaaaugcugauucagguaccucugucuuuuuuuuuuuguaaauaguacauauaguuuuauagaugacgauuccuucuguguuuuuuucugcuuuuuaaaaucuucauaucuuauauuuaaucuuaggcaucaucuguauacaugauuguuuaggucuuuaauuaccaguguuuagaaucaggucacucaaacaugguagauaaguuugcauaguuuguguauauccaucacucuugagacaguuuuauuuuaaguuccgggguacaugugcaggaugugcagguuuguuacauaaguaaacguaugccauguugguuugcugcaccugucaacccuucaccugaguauuaagcccagcaugcauuagcuauuuuuccuggugcucuccuuccccccacacacccccaccuccugacagacccuaguguguguuguuccccucccuguguccguguguucucauuguucagcucccacuuaugagugagaacaugugauguuuaguuuucuguuccugcauuaguuugcuuaggauaauggcuuccagcuccaucugugucccugcaaaggacgugaucuuguuccuuuuuauggcuacaugguauuccaugguguauaguuccacauuuuauuuauccagucuaucauugaugggcauuuggguugauuccaugucugugcuauugugaauagugcugcagugaauguacagguggauguaucuuuauaauacaaugauuuaucuuccuuuggguauauaccccguaaugggauugcugagucagaugguauuuuugguucuaggucuuugaggaauugccacacugucuuccacaacgguugaacuaauuuacauuccagccaacaacuugagacaguuuuugacucauaaacauucagagcuuggcuagcuaauuccugcuuuaauuuaaaaaguguuuauuauaugcaaauuggacaacucauauaaauauguggugcuacuuacuauguauuuucucuaaagcauguuaaaaaaauaggcuagauauaguggcucaugccuguaaucuuagcacuuugggaggcuaaggcaggaggaucacuuauggucaggaguuuaagaacacccugggcaacauagcgagaccccaucucuacaaaaaauuuaaaauacccaggcaugguggcaugcuucugauguuguagcuacucaggaugcucagacaggaggaucacuugagcccaagugacugaggcugcagugaaccaaaauuguaccagugcacuccagccugggccacaaaaugagaccuugucccugaaaaaaaaaaaagaaaaaaaaaauuuaaauagaggaaauacuagcuaaguuuaauguaggccaguucuaaaauaaugauuuauugcugcuguuguuacauaauuuucuuaaauauuuuaaagauugcauacuguuacugcucuauuucugcaucuccgugguguaacucuguccucuuuguuguugcaacaguucacuuagcaacuaaacuguauguuuacaaagugauuuuaucucccuaugagaagacuuuagugaauagcucagugaauaguagaguuggugagaccacaguacagaacuguuugaaguuuggguuaaauuuuuagaggaaaauguuugauacuaugcauaucauaguuaaagccaaugaaaaagcuaauauaggccaggcgcaguggcucacgccuauaaucccagcacuuugggaggccaaggcaggcagaucacuuaaggucaagaguucaagaccagccuggccaacaugguaaaaccccaucucuaugaaaaaaaacaaaaauuauccagaugugguggcaugugccuguaaucccagcuacucgggacgcuaaggcaggagaaucacuugaaccugggagauggagguugcaaugagcugagaucacgccacugcacuccagccugggugacagaacgagacuccaucucaaaaaaaaaaaaaaaaaaagcuaauacaugugaucacugaugaaaugcaauuaagaacugguuaguagaaaauucagagggucaagaaauuuaacagagcaguugaacucauuugccuuuaucguugagauuagaucaucuuucaggcuguuaguauauggacccuguuuuuaaaaauugugguuuuguuuuuuucaaugugaaagaauuaagaaaauuguuacuuuucuaauuccuuuucugugccuugcuuuucuguucacaccaguauuaacagcaaugaaauuuuuucaauuuuauuuuccaauaaaaauuacuuugaguuuuuuuuaugguagcuagcuacuuccuugaccuagauacuaauuuugauugaguugguaacuauuauuaaaaaaacaacuuaggucuaauuuaucuugagcuaaaaaauguaauaacugaaaaauagagcauauuuaggauucuuucugcuuuaaauuugacauucaguuauuuucauguaauuuguguuuugagcacuaccuuuuaauuaauuuauuuauuuuuauuuuuuagagacugucucauucuguuaccuagucuggagugcacuagugugaucucagcucaccguagccucacccuccugggcucaagcaguccuugcaccucacccuccugaguaacuggcaccacaggcauacaccaccacacccagcuaauuuuuauuuuucauagagucauggucucacuauguugcccaggcuagucucgaacuccugggcucaagcagucuuccugccucagccucccaaaagugcugagauuacaggcaugagccacugugcccaaacacuaccuuuuuaacuuagugaaaaauauuuagugaaugugauugaugguacuuuaauuuugucacuuuguguuuuuauguuuagguuuauugcauucuucugugaaaagaagcuguucacagaaugauucugaagaaccaacuuuguccuuaacuagcucuuuugggacaauucugaggaaauguucuagaaaugaaacauguucuaauaauacaguaaucucucaggaucuugauuauaaagaagcaaaauguaauaaggaaaaacuacaguuauuuauuaccccagaagcugauucucugucaugccugcaggaaggacagugugaaaaugauccaaaaagcaaaaaaguuucagauauaaaagaagaggucuuggcugcagcaugucacccaguacaacauucaaaaguggaauacagugauacugacuuucaaucccagaaaagucuuuuauaugaucaugaaaaugccagcacucuuauuuuaacuccuacuuccaaggauguucugucaaaccuagucaugauuucuagaggcaaagaaucauacaaaaugucagacaagcucaaagguaacaauuaugaaucugauguugaauuaaccaaaaauauucccauggaaaagaaucaagauguaugugcuuuaaaugaaaauuauaaaaacguugagcuguugccaccugaaaaauacaugagaguagcaucaccuucaagaaagguacaauucaaccaaaacacaaaucuaagaguaauccaaaaaaaucaagaagaaacuacuucaauuucaaaaauaacugucaauccagacucugaagaacuuuucucagacaaugagaauaauuuugucuuccaaguagcuaaugaaaggaauaaucuugcuuuaggaaauacuaaggaacuucaugaaacagacuugacuuguguaaacgaacccauuuucaagaacucuaccaugguuuuauauggagacacaggugauaaacaagcaacccaagugucaauuaaaaaagauuugguuuauguucuugcagaggagaacaaaaauaguguaaagcagcauauaaaaaugacucuaggucaagauuuaaaaucggacaucuccuugaauauagauaaaauaccagaaaaaaauaaugauuacaugaacaaaugggcaggacucuuagguccaauuucaaaucacaguuuuggagguagcuucagaacagcuucaaauaaggaaaucaagcucucugaacauaacauuaagaagagcaaaauguucuucaaagauauugaagaacaauauccuacuaguuuagcuuguguugaaauuguaaauaccuuggcauuagauaaucaaaagaaacugagcaagccucagucaauuaauacuguaucugcacauuuacagaguaguguaguuguuucugauuguaaaaauagucauauaaccccucagauguuauuuuccaagcaggauuuuaauucaaaccauaauuuaacaccuagccaaaaggcagaaauuacagaacuuucuacuauauuagaagaaucaggaagucaguuugaauuuacucaguuuagaaaaccaagcuacauauugcagaagaguacauuugaagugccugaaaaccagaugacuaucuuaaagaccacuucugaggaaugcagagaugcugaucuucaugucauaaugaaugccccaucgauuggucagguagacagcagcaagcaauuugaagguacaguugaaauuaaacggaaguuugcuggccuguugaaaaaugacuguaacaaaagugcuucugguuauuuaacagaugaaaaugaagugggguuuaggggcuuuuauucugcucauggcacaaaacugaauguuucuacugaagcucugcaaaaagcugugaaacuguuuagugauauugagaauauuagugaggaaacuucugcagagguacauccaauaaguuuaucuucaaguaaaugucaugauucuguuguuucaauguuuaagauagaaaaucauaaugauaaaacuguaagugaaaaaaauaauaaaugccaacugauauuacaaaauaauauugaaaugacuacuggcacuuuuguugaagaaauuacugaaaauuacaagagaaauacugaaaaugaagauaacaaauauacugcugccaguagaaauucucauaacuuagaauuugauggcagugauucaaguaaaaaugauacuguuuguauucauaaagaugaaacggacuugcuauuuacugaucagcacaacauaugucuuaaauuaucuggccaguuuaugaaggagggaaacacucagauuaaagaagauuugucagauuuaacuuuuuuggaaguugcgaaagcucaagaagcaugucaugguaauacuucaaauaaagaacaguuaacugcuacuaaaacggagcaaaauauaaaagauuuugagacuucugauacauuuuuucagacugcaagugggaaaaauauuagugucgccaaagagucauuuaauaaaauuguaaauuucuuugaucagaaaccagaagaauugcauaacuuuuccuuaaauucugaauuacauucugacauaagaaagaacaaaauggacauucuaaguuaugaggaaacagacauaguuaaacacaaaauacugaaagaaagugucccaguugguacuggaaaucaacuagugaccuuccagggacaacccgaacgugaugaaaagaucaaagaaccuacucuauuggguuuucauacagcuagcgggaaaaaaguuaaaauugcaaaggaaucuuuggacaaagugaaaaaccuuuuugaugaaaaagagcaagguacuagugaaaucaccaguuuuagccaucaaugggcaaagacccuaaaguacagagaggccuguaaagaccuugaauuagcaugugagaccauugagaucacagcugccccaaaguguaaagaaaugcagaauucucucaauaaugauaaaaaccuuguuucuauugagacuguggugccaccuaagcucuuaagugauaauuuauguagacaaacugaaaaucucaaaacaucaaaaaguaucuuuuugaaaguuaaaguacaugaaaauguagaaaaagaaacagcaaaaaguccugcaacuuguuacacaaaucaguccccuuauucagucauugaaaauucagccuuagcuuuuuacacaaguuguaguagaaaaacuucugugagucagacuucauuacuugaagcaaaaaaauggcuuagagaaggaauauuugauggucaaccagaaagaauaaauacugcagauuauguaggaaauuauuuguaugaaaauaauucaaacaguacuauagcugaaaaugacaaaaaucaucucuccgaaaaacaagauacuuauuuaaguaacaguagcaugucuaacagcuauuccuaccauucugaugagguauauaaugauucaggauaucucucaaaaaauaaacuugauucugguauugagccaguauugaagaauguugaagaucaaaaaaacacuaguuuuuccaaaguaauauccaauguaaaagaugcaaaugcauacccacaaacuguaaaugaagauauuugcguugaggaacuugugacuagcucuucacccugcaaaaauaaaaaugcagccauuaaauuguccauaucuaauaguaauaauuuugagguagggccaccugcauuuaggauagccagugguaaaaucguuuguguuucacaugaaacaauuaaaaaagugaaagacauauuuacagacaguuucaguaaaguaauuaaggaaaacaacgagaauaaaucaaaaauuugccaaacgaaaauuauggcagguuguuacgaggcauuggaugauucagaggauauucuucauaacucucuagauaaugaugaauguagcacgcauucacauaagguuuuugcugacauucagagugaagaaauuuuacaacauaaccaaaauaugucuggauuggagaaaguuucuaaaauaucaccuugugauguuaguuuggaaacuucagauauauguaaauguaguauagggaagcuucauaagucagucucaucugcaaauacuugugggauuuuuagcacagcaaguggaaaaucuguccagguaucagaugcuucauuacaaaacgcaagacaaguguuuucugaaauagaagauaguaccaagcaagucuuuuccaaaguauuguuuaaaaguaacgaacauucagaccagcucacaagagaagaaaauacugcuauacguacuccagaacauuuaauaucccaaaaaggcuuuucauauaaugugguaaauucaucugcuuucucuggauuuaguacagcaaguggaaagcaaguuuccauuuuagaaaguuccuuacacaaaguuaagggaguguuagaggaauuugauuuaaucagaacugagcauagucuucacuauucaccuacgucuagacaaaauguaucaaaaauacuuccucguguugauaagagaaacccagagcacuguguaaacucagaaauggaaaaaaccugcaguaaagaauuuaaauuaucaaauaacuuaaauguugaaggugguucuucagaaaauaaucacucuauuaaaguuucuccauaucucucucaauuucaacaagacaaacaacaguugguauuaggaaccaaagugucacuuguugagaacauucauguuuugggaaaagaacaggcuucaccuaaaaacguaaaaauggaaauugguaaaacugaaacuuuuucugauguuccugugaaaacaaauauagaaguuuguucuacuuacuccaaagauucagaaaacuacuuugaaacagaagcaguagaaauugcuaaagcuuuuauggaagaugaugaacugacagauucuaaacugccaagucaugccacacauucucuuuuuacaugucccgaaaaugaggaaaugguuuugucaaauucaagaauuggaaaaagaagaggagagccccuuaucuuaguggguaaguguucauuuuuaccuuucguguugccaaucacuauuuuuaaaguguuuauucaguagacuugguaugcuaacaauuaagaguguuauaaacuaugucuuuucagccauuuuuguguagucaguuugggggaguaugguuugauauacagauacacagauucaguauucguauacagauuugauaucuugguauacagauucgauaucucugaaucuguauaccaagaaaucauguuuuaagggucucaauauauuuucaaaaagauuauuaguauaauaauugagaaauuacuguuaaaaaguuuugaguuucucuagaaaauuugaaacucuuaacaaaaccugcauaauacuaacuuaacuguuuucauauacauagcaaguucagacucugacuuauaugaacuuuaaaaguugguuuccgggaggccgaggcgggcggaucacgaggucaggagaucgagaccaucccggcuaaaacggugaaaccccgucucuacuaaaaaaauacaaaaaauuagccgggcguaguggcgggcgccuguagucccagcuacuugggaggcugaggcaggagaauggcgugaaccugggaggcggagcuugcagugagccgagaucccgccacugcacuccagccugggcgacagagcgagacuccgucucaaaaaaaaaaaaaaaguugguuuccgauuauaccauuuacuggguaauauauacuacuuaguuacacuacuuacauagcuucaguuuccuuaucuauaaaaugcaaauaacaccucccaugagggcugggcguggcgcucaugccuguaaucccagcacuuugggaggccgagguggguggaucaccugaggucaggaguuugagaccagccugaccaacauggugaaaccccaucuuuacuaaaaauacaaaaaauuagccaagcgugguggcgcgcaccuauaaucccaacuacuccagaagcugaggcaggagaaucaccugaaccugggagguggagggugcagugagcugacaucacaccacugcucuccagccugggcaacagagcgagacugucucaaaaaaaaaaaaaaaaaaguguauuuaaagcacuuagcagugaacuugacauauaguaggcagagagcauucaguaaguguuggcuugcucccuuuuuuucauuuaggaagugaucuaaaaacaguauuguuaguaaaugguaucuugaucuuaauguuauguggacuauuuuaacuucccuuuuaaauguauauauaucuaacaacuuaguucaacuacagucaugugucauuugacagggauauauguucugagaaauagauuguuagauuucaucauugugggaacaucauagaguauacuuacacaaaccuaggugguauagccuacuauauaccuaggcuguaugguauagcuuauugcuccuaggcugcaaaccuauacagcauguuacuguccugaauacucuaggcaguuuuaacacaguggcaagcauuuguguaugugaacauagaaaagguacaguaaaaauacgguauuaaaaucuuauggggcugggcucaguggcucaugccuguaaucccagcacuuugggaggcugaggcaggcggaucaccugaggucaggaguuugagaccagccuggccaacaugguaaaaccuugucucuacuaaaaauauaaaaauuagcugggcauggugguggcacacgccuguaaucccagcuacuagggaaguugaagcaggagaaucacuugaacccuggaggcagagauuucagugagccaagaucgcaccacugcacuccugccugggcgacagagcaagacuccaucugaaaaaaaaaaaaaaucuuaugggaccacuauuaaagucuuauaggaugaccauugcauauguggucuauuguugaccaaaaugucauuauguggcaaaugacugcauuagguuaaccuuauacauaccuauauuagguauguauuugguuuuguuuuuuuguguguguuuuuuucuauuaguguaucugacugguaauaaucuuaaauaauugaaucuguuuguuaguugcaauuaaagcaaaugccaaaacuccaacauuucaguggauaaucuuaaauaacuaguuccuuuuuaaaaaaccuauaaacucauaaaaauauuuuaguuauuagaacucuuccugucuagaccccauguauuacagagagacaccgaaguuagucuccucauucaaaaagugccuuuugccccuaagucauucugguggauacagauuuacuuaaucaaguguuguccaggucacauucaauauaggauuuacuuuauggacaaaguaguacguuuauaguacuuaaacuauuugcuguccuuuagugugaaauucugagguauauaugcuuaaagauauuuguaauucuuuuguggaaaauaauggcuuuauuuauagcaacccauucuguucuugugcauacugaaguauauugacuuuccaccuagggaaaaaaaaaacaauaacucagacuuguaaaugcuuucaacgguguuacuacuuaauuucccucauuucuguaacauauaaguguauaacuuagucagcuucugguuacuggaacaguacaggucacuguuaaacaauuaaaccacuuuuauaauaaucuaacaccuccuaaagccuugcauggacauuuuuacuuauuaaauuauacaaauuuauucccuguaauaaagcaucaaaaagcaaaguaccuguuauauauuaucucagcaugacauggaaaugccuaccuugaauuaugguuuaaucuuacccucuuagccucuguagaauuuuuaaauaagaauuguuucuauuacuaguacuuuaauguaauuugauaauuguaaaaagccucuuaacucuaauucaaggaccuacauaauaaauuacuccuucaguuaauggcugcccccgugcugaaaaaaaaaaaaaaaaagagagaaaaaguuuauuugaagaaauuuuguuaggccuuauugccaguaaaccuagaguuauauuuagugucaguuuuucaaaaaguagcuuaucugugguaucugguagcaucuguuuauccuauuuaggauuuauccuguuuagacccuguuaaauagugguguuuuaaaguggucaaaacagaacaaaaauguaauugacauugaagacugacuuuacucuuucaaacauuaggucacuauuuguuguaaguauuuuuguuuaacauuuaaagagucaauacuuuagcuuuaaaaaaauggucuauagacuuuugagaaauaaaacugauauuauuugccuuaaaaacauauaugaaauauuucuuuuuaggagaacccucaaucaaaagaaacuuauuaaaugaauuugacaggauaauagaaaaucaagaaaaauccuuaaaggcuucaaaaagcacuccagaugguaaaauuagcuuuuuauuuauaucuguucucccucuauagguaugguauauaauauucugaccucaggugauccaccugccucucaaagugcugggauuacagacaugagccacugugccuaaucaaggaccucuuuauacucuuaaaaauuacugaggaccuaaaagagcauuuguuuauguggaauauaucuauugauauuuaccauauuagaaauguaaauugauuaauguuaaaauuaguaauauuaugcguuggucauuuggaagauaugaguucacugaguuaugcggaucuuccgaaaguugacaguuuuauuaugcaguauuaaacaaucacuuucauugaugccauuaccgaucagaaaaguuuaaguaguagaaagcugucaagcuuacagagccagauacaagcuucccaaaaauucugauuuucaucuaaaagcuugaauuuuuccccggcaauaaguauugucacuuauuuuucuuguaggugacaagcuuauuuucauucauuuuugaaaagaugucugccgaauacccaagucugaauaacuauaguuuguugguuauucuuucaaguaaaagguauuucaugaaaaaauagcuaguauagcucacaacucaaucauuuaaguguguuuucuugagaaacgcacugaaguaugcaagcauaauauaccaacaguacaaauaucaacagugaaaaggacauacauaacauuuuacuaauaagacaguuuugacagcuuggauucccuaaaaugguuguagauaccuaacaggauuccacugaucauuucuugagaaucauuguccuauaauauauacauaauaaucuaaauuuacaauaucaguauuaacuacugacaauaaaacuacuaaggaaaauguaagaauuguuugcaguuuuuguccuuagaguauauagguugaguaucccuaucugaaaugcuugggaccaggacuauuucagauuucagauuuuuucagauuuugaaaugcuugcauauacaauacauaaugagauaucuggggauaggacucaagucuaaacacgaaauuuauuuaaguuucauaaacaccuuauacauauaacuuaaauguaauuuuauacaauauuuuaaauaauuuuugcauaagacaauuuaaauugugauccaucacaugaggucagauguggaauuuucuacuggccucauguuggcacucaaaaaguuucagguuugugaccauuuuggauuuucagauuagggauacucaacccauauauuauuaagaauguuuagucaaaauacuguguucaaaugucacucaaaauaauucuuccggaugugguuaccaauuugauaauuagguuacauuccuuuuuuuccauuuguuuucaauuuuaggauuugucuuuucuuauuuaauuuuacauuugaauaaauaaaacauuacauaguucauucaucagaacuacaaaaagguauacuuagaguuuuuauucacccaccucuugcuuacuauagguaaucuuuuuuaguguuuuuuuuucaggauucuguuuaauaaaaauaagcaaauacauguauauacucauuacccuuucuuacucaaaagauacaguauauacaccauuuugcaccuuguuuauugguuguuguuuacuuaagaauuauuuggagaugacuccuuaaugaguauauagagaucguccucauucuuuuuugugguuacauaguaguugaucaucuggcugugucaguguuuccuaguuuauuuaaccaauuuccaacuaguggacuuauugaagauuuaauuagguuccaguuacauacugagaaugaacaauaucuaaagcuuagcuuuuaaaccuucauaagacuaaauuuuaaauuugguauuugcaucagaaauuagcuaacaccuuugaguuaugaugguuaacaucaacugacuaaauuuaugcugauuucuguuguaugcuuguacugugaguuauuuggugcauagucauuaucaauuugugaaucaauuuauuuucauaguuaacauuuauugagcaucuguuacauucacugaaaauuguaaagccuauaauugucucaaauuuuuuguguauuuacaguaacauggauauucucuuagauuuuaacuaauauguaauauaaaauaauuguuuccuaggcacaauaaaagaucgaagauuguuuaugcaucauguuucuuuagagccgauuaccuguguacccuuucgguaagacauguuuaaauuuuucuaaauucuaauacaguaugagaaaagucucguuuuuauaaaugaacauuucuaaaaauaaugacacuaacguuaagaaguuaacacuucccguuuuauaaaauuuauaaaauacuuugguaguauuuuauagugcuguucauaucauuauuuuauuuuuuaauuuuaugacagcuuuguaaaguagacagauuuuauucuaauuuuauggaugaaguacuaagguugagaggaauuaaggaaauugcuccgaaucaguuaacaaaaagauugcagauauuaaaaauauccuuuuaucucuccucucuaaaccuuuaaaaaaguacuaagauaguuuuuuuaauguauaauucccaaggacaaugaugagaagaaacaacaaaaguuuggaagccaaaaacauaaaggauuuaguaagcaugagaaagcuaaaaccugacacuagagcaaacagagaugcuuuccccuaaaaaaccugaaaaagauucaaauuggcagcaacagguacuucugaaggugaaguagaaaauaggaagauuaguugaaauucuuuuuaagaaacaucuauauuuccucccccacugcaaauaggcgguuauccuucuucugccaggaaaucagaagguuguucuugaaaaagaugaauugagaggauucugaauugaaggugggcuggagggaggggacaccaggcacaauugagggaaagauacuaaaaugaaagaucagauacaaaucuguaugucaagcagugagaccuagcuccuucccacacuugguucccaaaugcaggcccucuaggcaugagacuggaagauuuuuuuuuccuagggaauaugccugacccaauagaaaagaccaaaaaauacugacaguugaggauacucagaugaaacaguauagccagucaccagaccaggaaguuaacuguugacaugcacagagcuuccaggaagcuacuuagugcuucacuuuuaaauaagaaaagauagucaaagauaacuagucauuggaagaaagcuacuaugaaacauagucaccaaaguacaaaauccauagcagaaaggaaccuagaggaaaucgacuaugaaaacuucauaaaaaccuacuaauauucucagguaagaaaagaaaaaauggccguaaaauaagaacaaguugcuauaaaaagcucuuagaaauuaaaaauaugauagcacaaauaaauuaacucaguagaaauaauggaagaaucaugaaaguucccagaauacagaauaaaaugaaaaaagguaugaaaagucaauucuguggaucuaucaucugaaaauacagaguuugagaaggaaggcacagaagagaaaugaagaaagaaauuuuaaaauaaauacauaauuuuaaaaguucuacuaguacugaaggacaugaguuuccuuaauuaaaagggcccacugagugagcacacaaguaaaaaugacccacaguaaggcacauccuugugaauuuuuagaauaauagaggcagacaggaaccuuaaauucauuagaggaccaagaaguuagguuucaaauuguuucaagccauaauaguaugaauucucuuauuaucaacaauggaaucuagaagacuguagaucuuauauaauacagagaagugccuucaaaauacugagagaaaaugauuuccaaccuagaaucugaauuaagugugaggguagacauuuuucagaugugaaguacuaaaagaucucuugugcgcuuuucucaggaaacuaaccaaaacaaaugcauacaccaagaaggaggaagguauaggacuuaagaaauaagaauucaacauagaagagaggcaaagggagcuuucaggaugauauugaagggagaucccagaguagcuguguugcuaagucuagaaaggcagcuagacuacuuuggaacugaagaagauaagagacuuuggaagaguuugccuucaagauaaaaauaaagcaguaccugcauguuuuaauguauuaggaaacuucuuaguaaagauggugaauugaggccaggcacaguggcuuacaccuguaauccagcacauugggaggcugagguggguagaucacuugaggccaggaguucgagacuagccuggccaacaugguaaaaucccaucucuacugaaaauacaaaaauuagccaggcgugguggcacacgccuguaaucccagcuacuccagaggcugaggcacaagaaccgcuugaaccuuugagguggagguugugguaaaauugcaccacugcacuucagccugggugacagagugagacucugucucaaaaaaaaaaaaaaaaaaaaaaagauggugaauugaacauacucauauccuuucuuugccuuccaaacuuuuaccaaaacaucauugaagaaacuuacacacacacaaaaaaaaaacaaggaaaauaggaaauaacaaaguaacuaaauuucucaaagcaugcagaaggaaacugaaugaaagcuggugguggggacagcagagaaccaacgauuuuacacucaggucucaaaagacuaggaauugguggcuucauuucuuaucuuuagaauuggguggugcagaaggagggagccaaaauggaauaaguugaaauuauguuuaagaagcaauacucgccggguacgguggcucacauggaggcugaggcgggugaaucaccugaggucaggaauucgagaccagccuggcuaacauggugaaaccccaucucuguuaaaaaugcaaaaauuagcucggcaugguagcaugccccuguaauccagcuacucaggaggcugaggugggagaacugcuugaacccaggagguggaggcugcagugagccaagauugcgccacugcacuccagccuggacgacagagcaagaccccacaucaaaaaaaaaaaaaaaaaagcagcagcagcaauacucaugaagcugggcaacugucuccugcccgcucuaugaaaagaaccagaggcuuauucuccagagaggauacaguagaaggugaacacacuaggcacaguugaaggcagaagcaacuacuugaaagcaagaagaaguuaauauaugcauauugaauguugggaucuccccucaccaagcccuuuuccaccacucagcuuccagaacauagacagcuaaguuuucacuaguggaaguuuccauuuaaucaagcuacuguguagcuugcagucaacaaguucuaucuuuguaccaagugcuucaaaacagccuuuuggucccucacucuuaacuauaaacagacauccaaagauuaugagacaucagaaaaagcaaaaauaaaauaaccaaaaaacacauuaaugaaaacaacuuagaagaaacauuauucaaggagaagaaaaaauguuuuuuuaaaaacuauaauuugugaacagaaugaaaagagguuuauauauauagcuaagaguuuagaugugaauaaacaguaaguacauagaaaauaagcagauuuuaaaaauuaacucaagagaaagcaaaaguuguaaaggaaguacacuauuuauauacuacccauuaauggccggguguggugguucacgccuguaaucccagcacuuugggaggccgaggcggguggaucacaaggucaggagaucgagaccauccuggcuaacauggugaaaccccaucucuacuaaaaauaacaaaacaaaauuagccagacguaguggugggcgccuguagucccagcuacuugggaggcugaggcaggagaauggcaucaacccaggaggcggagcuuucagugagccgagauugcaccacugcacuccagccugggcgagagagcgagacuccgucucaaaaaaaaaacaacaaaauaaaaaaauaaaauaaaauauacugccuauuaauacuacauauacuuuauacugacuuagccguaauguaaauguugaacauugauagugagaggugaagcuggcugggcuucugggucguguggggacuuggagaacuuuucuguccggcuaaaggauuguaaacacaccaaucagcgcucugugucuagcuaaagguuuguaaacgcaccggucagcacucugugucuagcuaaagguuuguaaaugcaccaaucagcacucuguaaaauagaccaaucagcaggacgugggcggggccaaauaagggaauaaaagcuggccaccugagccagccccagcagccgcucggcuccacuuccaugccauggaaucuuuguuuuuucacucuuugcaaugaaucuugcugcugcucacucuuuagugagcacuaccuuuaugagcuguaacacucaccacgaaggucugcggcuucacuccugaagucagcaagaccacgaacccaccaggaagaagaaacaacccuguacgugccaucuuugagagcuguaacacucacugggaaggucugcggcuucacuccugaagucagcaagaccacaaacccaccagaaagaagaaacucuggacacaucugaacaucaggaagaacaaacucgggacacacuaucuuuaagaacuguaacaccaugaggguccacagcuucauucuugaagucagcaagaccaagaacccaccagaaggaaccaauuccggacacaguagaauuaaauacguaauuuaggaagaugaaaggcaagaguguguguguaguaagguagaagcuguguugacagagcugaauuuucauuuucuguagggguacuucaagagaaaaagucaagaagaaacaugucacuuagacauauaaauaugauaaaaucaucuaaaacuguuuaaaguaguugcaaaaucuuuucuagcugauaaauuuuuaagccuaaaaauaucauugaaauuauuuuaauguuacauuuuauuuuauuuuauuuauuuauuuauuuauuuugauacagagucucacucugucgcccaggcuggaguacaguggcacgaucuuggcucacugcaaccucugccuccuagguucaagcgacucuccugcuucagccucccaaguagccgggauuacaggcgcgugccaccaugcccggcuaauuuuuuguauuuuuacuagagaagggguuucaccguguuagccaggauggucuggaucuccugaccucgugauccgcccaccuuggccucccaaggugcugggauuacagacgugagccacuguaccaggccuaauguuaccuuuucaaaaacaccugauuguggaauuguugaagucacugaguuguauuucuggaauguguuuuuuagcaggcugcacauacacauauguagaaagccaggugauuuuuuuuucauuucuuuuuuuuuuaucaaaaacaguuguauuaaauaagaaaggaaauacguauuuacccguguauuaccuuaauuuauguguaaaaugggagaauaguuuaauguauuuaacaaacaaacauuuguuaaaguaccugcucaaacuaccuaauauauacuauagugaaagauauaaggauaaauaagucuaacucagauugcuagccugggaaccagacaugaaaacaagaauuauaauguaauauaaauucuagaauagauguaaaaagugaucuaagaacauagaaaaauuaucagcuaaucacaugacugcucaaugggaaaaguacuucagacagaauguaaagaaugcuugguuaaagauggcauuccaaaucuuggaauuugguugggggacagagggaaacaaaaagaaauggggagguuaggaccaaauaggaagcuuccuguaugucauuucugauaaguugaaaccuagguaggugauaggcugucuuuggaaguuucuaacaagaggaacaaaauaagauugguguuuuagaaguauaccaaagcaaaacuguugcaaggagauuaguaaauacaggucuuaaccuagcagaggagguagaggguagagaaugauugagauagaaauucaguagauuuggccagauagugauaaguugagacuggcaaauuauuuccacuuagauuuaaauagauaucuugagcauaaccuacaaggcaaacuccuuauacuaaaaauauucugaauauuuaaaaagaaaggauuaaaagaucaaucaauagaaguuuggggacagaagguuuauucauucuugugcauuagaucucaucuagaucaccuguuugaagaaaucauuccagcaauuaucuugucucucuccugcauggauuuuuuuccuaauagauuguucucaucacccuaagcaguuguuguacaucucucaucuuaaaaagaacagccuuucuuaaguaaucucaacaguccauuuucuucucuuaaagcccaacucauuagaauugucccuccucuuuucacuuaucucuuugaguacucuccugaacccagucuagucaguccuuucaguagaacuggucccccugcuuaccucccuacuccucaauacacagugaauucucaacaaagaagccgggggauccuuuuaaacauaagacagauuaugucauuucuuuacucagaacuauuccguggugugccaucucagaguagagacuaaaagcccuugucaugguguacagauucuucaugaucuggcugcuuugcuauuuuuccagucugaccuucuaauguuccccuugcucuccuugcuccaggcacacuugugucuaggccaaucgacauauuuguuugucuguuuccuuccacugaaauauacaugcaaaaacaaaauuuuguuaccguguuccccagcaaaacaaugucuggcaccugguaggaauucauuaaauaguugauggaugggcgaacggauaacuaaaggaacaacuucaaguuccagguauccaggguuugguaaaaggaaaucugggguuuucaacaagauaucaaguauuaggaagaccacguaugcugagaaagaugaucacuuuuggacauguugaguuugaaaugagugugaaacaucaagguacagaugucugaugcuauauguaguguaaaauguaggaacaacccuaggagaaaaaucgggcaugaggauaaaggauauuuucauuguuaggugauaauuuaagcaauggaaaugacucacauuagcaagggaaagugucuaaggaagacauccaguuuuggagacuuuuuuugaggaaucaggaagagguaaaaccaguaaaagaugaaagagguacagugauggugagaauuuuaaaagaaggaaaauguaaacugucauagcuauuaggaaaguugaguagaaugaguuugcgugcaucccacaugcaucugggaggucauuaacaacuuuauugagaacaguuucuguagaguagugggagaaaugagaguuuauugaguagagauugaggaagugaaaauagcuacauuaccuauugaagaagguugacuguggaguguaacagugaguauuagcuugaggcagagauaaaggugagugagaaaauaagaguuucaaagguaggcaagauuuuugggcuaaauaaaaagggcacuuuaaaaaagguauaaauagguagaagagagaaaagggagcgaggugggauaauugaaagaggggaucuccuguggagacugagguauuaggcggaguagagaguucaggugaagaugugaaggugagagaagaggauggguagacauuucccuggugaaggagguaaggaguacuaugauggaauuagaggggacacacugagaggguccacacuugacagacucucuucuauuauguguuaugugagguagauuguaaagucaaaggcuagccuugaaaaaugugauauuguuuuggaauggcaaccauggugaauacaaaacaguuaccagaauaguaucaccauguagcaaaugagggucugcaacaaaggcauauuccuaaauauuuauauguguacuagucaauaaacuuauauauuuucuccccauugcagcacaacuaaggaacgucaagagauacagaauccaaauuuuaccgcaccuggucaagaauuucugucuaaaucucauuuguaugaacaucugacuuuggaaaaaucuucaagcaauuuagcaguuucaggacauccauuuuaucaaguuucugcuacaagaaaugaaaaaaugagacacuugauuacuacaggcagaccaaccaaagucuuuguuccaccuuuuaaaacuaaaucacauuuucacagaguugaacaguguguuaggaauauuaacuuggaggaaaacagacaaaagcaaaacauugauggacauggcucugaugauaguaaaaauaagauuaaugacaaugagauucaucaguuuaacaaaaacaacuccaaucaagcaguagcuguaacuuucacaaagugugaagaagaaccuuuagguauuguaugacaauuugugugaugaauuuuugccuuucaguuagauauuuccguuguuaaauaauguccugaugguuuucccccuuugguggugguaauuuuaaagcccuuuuuaauguuuuagauuuucuaaauccaaagauuagguuuaaauuauucuaauguuucuuucaaagauaacuucuuguggacuuguuaaaaaaaauuagacacacaaucuaggacugcuguuacuggaauauauuuucuaucaugcuacuaauuuucuuuuuaaaaugugauaaaaauagggccgggcgugguggcucaugccuguaaucccagaacuuugggagacuaaggcgggcggaucaccugaggucaggaguucaagaccagccuggccaacauagugaaacccugucucuacuaaaaauacaaaauaaauaaauaaauaaauaaauagcugagcgugguggcaggcaccuguaaucccagcugcuugggaggcugaggcaggagaaucguuugaacccgggaggcagagguugcagugagccgagaucgcgccauugcacuccagccugggcaacaagagugaaaaacucugucucaaaaagagauaaaaauaguaaagauauucauauuuauacagcuuuacaaguugaaacauccuuucauuuaugaagaauuaaaagggguacccuuuuuagagaaaaggagagcauguaaacuucgaggaaauugauauguauaauuuuauaaaacagggcuugcgcuuuuuuuuuuuugagacagaguuucgcucuuguugcccaggcuggagugcaauggugcaaccucggcucaccgcaaccuccuccucccgaguucaagugauucuccugccucagccugcugaauagcugggauuacaggcaugugccaccacaccuggcuacuuuuguguuuuuuuuacuuuuauauauuuuuuuuuuguuuaguagagacaggguuucuccauuuuggucaggcuggucuugaacucccgaccucagaugaucugcccgccucagccucccaaagugcugggauuacaggcgugagccacugugccuggccagggguugugcuuuuuaaauuucaauuuuauuuuugcuaaguauuuauucuuugauagauuuaauuacaagucuucagaaugccagagauauacaggauaugcgaauuaagaagaaacaaaggcaacgcgucuuuccacagccaggcagucuguaucuugcaaaaacauccacucugccucgaaucucucugaaagcagcaguaggaggccaaguucccucugcguguucucauaaacagguauguguuugucuacaauacugauggcuuuuaugacagaguguaauuuuauuucauuaacuaguaucuacaaauggcuuuguuuaaagaaugaacacauuagugcaggaauggaugaaugaaaucaucauauuuucuaauuagccugcaguggcagccucuggccccuugcuaggccugccucauccugcuaaagugaucugugcuuccaaauuacuacuucuuuucccccuucaaaucuuucuuauuuugucauuguaaaugcucucagcuagguguuaaaguagucuuacugauauucaaaugugaauaacugauagcccugaaccuucuaugagcuauuuauauuuuccaaagaggauucuccuuaagccaauauuaucuagguagaauuuuaggcaauggagaggugaaaauaauauugaugacauuaauagcuaacuuugagcauuuucuagguguaagaugcucuucuaagcacuucacaugcauuagguauaucuugcuuaauccucacagucaccuugaaagaaaggcacuguuacuuuguuuccauuuugcaaaugagagaacugaagcauagagaggguuaaguaacugccccaaagucacuuaacuaguaaguggaagugcuaugauuccaaagcaaagagucugacuccagagucaaacucugaacaaacaaaaagacacuuuggguuagauauccuggggugaaagcaagcacuuugaaaguaagccaagccuguguacagaucugaccaccugaggucacauucccuaaaauacuuaaacuucucccuuuuguuucccaucuaaguuuuugaacuuaagagauuuuguaaaacaucacauuuuuuuauccucacaguaccuuccuauggcagauuuagcaggaggcguauaaacgggguggaaaagguacagcagacuguggaauguauggaucauuuauauuacauuaaaauuuuuaguuucuaguaaauaacuuaaauguuuuuguagugaagauucuaguaguuaaugaaaauuuuugguaaauucaguuuugguuuguuauaauuguuuuuauugugugauacauguuuacuuuaaauuguuuuucuuuuuuguguguguuuauuuuguguagcuguauacguauggcguuucuaaacauugcauaaaaauuaacagcaaaaaugcagagucuuuucaguuucacacugaagauuauuuugguaaggaaaguuuauggacuggaaaaggaauacaguuggcugaugguggauggcucauacccuccaaugauggaaaggcuggaaaagaagaauuuuauagguacucuaugcaaaaagauuguguguuaacuuuuauguauucccucaucccucuuucuucucuuaacugucucucgaacuaaaaaguuggcuagaaaucaaauuuuuaugcauuuaauuguuuuaagugcauuaugguuaagcauucuguagaagucuuuugaaaagugcuguuuguccugggguuuaaugaacuggauuuucuugauuugggacauuuuucuuaggcauuuauaaauauagcccaauuuauaaaguuaaauuuggccggguacaguggcucaugccuguaaucccagcacuuugggaggccgaggcggguagaucaccugaggucaggaguucgagaccagccuggccaacguggcgaaaccccaucucuacuaaaaguacaagaacuaucugggcgugguggcaggcaccuguaaucccggcuacucuggaggcugaggcaggagaaucgcuugaaccugggaggcagagguugcagugagccaagauugagccacugcacuccaggcugggcgauaagagugagacuccaucucaaaaaaaaaaaaaagaaaaaaguuaaauuugagggccagacaugguggcucaugccuguaaucccagcacuuugggaggcugaggugggcagaucucuugagcacaggaguuugagaccagccugggcaacauggugaaaacccaucucuacaaacaaauuaaaaaauuagcccagccaggcgcgguggcucacgccuguagucccaacacuucggaaggccaagaugggccaauuaccugagggucaggaguucgagaccagccuggccaacauggugaaaccccagcucuacuaaaaauacaaaaauuagccagguauggugaugcaugcccguaaucccagcuacucgggaggcugaggcaggagaaucauuugagcccaguagguggagguugcagugagccaagaucacgccacugcacuccagccugggcaacagagcaagacccuauuucaaaaaaggccaggugcgguggcucacaccuauaaucccagcacuuugggagguugaggugggcagaucaccugaggucaggaauuugaaaccagccuggccaacauggcaaaaccccaucucuacuaaaaauacaaaaauuagcuggacgugguggcacgcgccugcaaucccacuuacuugggaggccgaggcaggaaaaucguuugaacccgggaggcggagguugcagugagccaaaauugcaccacugcacugcagccugggcaacagugagacuccaucucaagaaaaaaaaaaaaaaaaaaaaagaaaguuaaauuugaaauggccuuaugguagauuccucccccgacacacacuuacuucauguuuucuuucauuauauauuuuaauggauacaaaauauaaauaaacacuaaaaguuaaacagaaauauuugaauaucaauaaugccaaauaacuagaaaaucucagagcucuaaaacagcaacaauuuagaaacuauauaaccucuuuuuauuguaguuuuuacagaaacauaauuuaaagcuuuuuguuaucagagauauauuacauuaugccaguggcaaaagaugggauuuauuuccucagcauccuuaucuuuaaauuucuguacaucuuuccaaaauuuauagcuuuggaaaagugauaaaacuuuuuuuccugaauuuuguuuuaacuuuuaaaaacagaaauauuguuuacaucuugcguaucuuauauaacaaacaucugcuuauagauuccaguaagaaaaguugguuaaacgguuguauuauuuucucguacuaaauagacugcauaagguagaaguuaagaaugauugcccuguagucuaaguggaaauguggaggcuuucguuaguuuuuucugauaauucagcaaaucucuauugagcacuugcuaugugccagguacuauucuggguacuagggauaauaaaggaaaacaaaaaagucccugcccugaugagucauacauucuauguggaaggcauagaaaauauugaaauauaagugaauuguguaguauguuagaagaagauacauacuauaaagauagauaaaguuggaaagguggcagagaaaguugggcaaggagaugcgauuuuuaaucuaauaaguaguuaggaaggcuucacugagucagcuacauuugauaaaugaccuaaaguaaaaggagggagcauaggacuauccuagcaaaagacccccagccucuaagaggggagcaugcuugaaguauuugaggaacaggaaguuagugcaacuggaguagagugggcaggagaagaguaguaguagaugagauacaaaaggaagaccucauagaccuucguaagacccuuaccuuuuacucugcacgauuuuuacugaauaaaccacuggaaggcuuaaaggguaacaugaucugacuuuuuuuugagacagucucacucuauugcucaggcuggagugcaguggugcaaucucggcucacugcagccuccaccucccagguucaagcgauucuccugccucagccucccguguagcugggacuacaggcgcgcaccaccgugcccggcugauuuuuguguuuuuaguagagacaggguuucaccauguuggccagguuggucucaaacuccugaccucaggauccacccuccucggccucccaaagugcuggaauuacaggugugagccacuguguccagccugaucugacuuauuuuugaaaaaauaauucuggcuguuuguugaggagaggggcaaagauggacacacagagaccacuuaagcuauugcagaaauacaugugagaggugguugguuggaccagggaaguggcaguggaauugguggaaagcaguuggacucugggguauuuugaaaguggcacuauuaggaguugcucaaggauuagauauaaaacgugagagaggaggagaauaagaauggcugugaagauuuuggccuuagcagcuggaaggauagaguuguauguaacuacuagaauugagaagaccaaagauggagggaaauggagaguuugguuuuggacauuugaagcuugagauguaauaguagacagccaaguggagauguuagguaggcaguuggauauggaagucuauacacagguaaaguauaggccaaauaaaucaauucacaagucaucggcauauagauggacuugaaggccaugaaaaagagacugagaaagagcagccagaaaguuaggaauaaaugcagaaugggguguugcauuccaaaugaagauggaauuuuagggaauagaaaaugaccagcuguggaagcugcuucuaauagguaaaguaagaugaggacugagauuggccgcuggauuuagcacugcagaagacauuacuaauguuauuaaaaauagcucaauagauugguggagugauauccugauuagaaugcaauuaaagagcaguugaagaggaggaauuggagacacagaauacagucgauucuuuugggaguugccaaaaagaagcagagagagggacauugcuuggagaggaaguaggaucaaagagucuuaguuuuggcuuguuuuaagguagaaaaaaaccguuucuuaugcugauucacauuguucaguagagagggaaaaaauugaugaugcaggagagagaggaggcauuuccugaucguuggccuuguaggcagcaagggguaggagcuagugcacaaaugguagaagagggcaaaguguaaggaugcagaugcuuggaagagggcaaaguguagggauacagaugcugugaguggauagauaugagggugggagcuuauggaaguucucuuuugauuacuucuguugucuuagugcuaagaguaugaaugagaaaggaggaguuagagauuugagaacagaggggacaggaucaaagagagcaccaagacuaagaaaggcaguucucaggcgugauuucuaaaaaaaucucuuucauaagaaaaauaaucuaaaauauaauuauuuaaaaucaaggaucucauuuuucaggaacaaauaugaguugaaaucauucuguugacuguuaaguggaauuuuuuguuuuguuuuuauauuuugagauagggucucacucuuguccaggcuggagugcaguggcacuaucauggcucacugcagccucaaccuccugggcucaagcaauccucccaccacagccuccuaaguagcugggaccacagaugugagcuaccacucuuggcugauuuuuuuuauuauuuuuuguagagaugugggggucucacuauguugccuaggcuggucucaaacuucuggccucaagcaauccuccugccucagcuucccaaaaugcugggaguauaggcaugagccaccaugcucagcaaugaaguuuuuaucaguaugauacuuugauacaugucaaauaauuuucugaaauuauauuguagaucauaugaacucauaaaaacuuaaugaucuugaacaauguaguuuuuguacagagaauaguuguaguuguugaauucaguaucauccuaugugguuuuuaugauaauauucuacuuuuauuuguucagggcucugugugacacuccagguguggauccaaagcuuauuucuagaauuuggguuuauaaucacuauagauggaucauauggaaacuggcagcuauggaaugugccuuuccuaaggaauuugcuaauagaugccuaagcccagaaagggugcuucuucaacuaaaauacaggcaaguuuaaagcauuacauuacguaaucauauacggcaguaugguuaagguuucuguguagucugugacuuccaugucaaaauguugcacaagccaguugucagugacaguugccaucccacacugcuguucuccugucaucccuagcccccauuuaagagagaucacacauucaugcauugcuugcuucccucuuuccccacccccuccuuaaccucuugauguaugagaagaauaugaguuacuaauuugauccacuauuuggggauugcuaauaaagcauuuuugcauuuuauuuuuugcuuuuuaaaaauaauugauauuuuaacaauaugaaacaauauauuccuagcuacaaaauuuuuaauucucaguauuucuuagauaaauucaguuuuuauucucaguuauucagugacuuguuuaaacaguggaauucuagagucacacuuccuaaaauaugcauuuuuguuuucacuuuuagauaugauacggaaauugauagaagcagaagaucggcuauaaaaaagauaauggaaagggaugacacagcugcaaaaacacuuguucucuguguuucugacauaauuucauugagcgcaaauauaucugaaacuucuagcaauaaaacuaguagugcagauacccaaaaaguggccauuauugaacuuacagaugggugguaugcuguuaaggcccaguuagauccuccccucuuagcugucuuaaagaauggcagacugacaguuggucagaagauuauucuucauggagcagaacuggugggcucuccugaugccuguacaccucuugaagccccagaaucucuuauguuaaagguaaauuaauuugcacucuugguaaaaaucagucauugauucaguuaaauucuagaaguuuuacauuuaaauuuuaaaugcuuacuaaggaugcucaauuucuuagauguacugauaauuuuaguauaaaaagcauauucuucagacaguuaaaguuuuugugcaguuuuugggagguccagagaucuuucuugagcuuaaauaaugcauuuccaauuaaaaagcaaaauaaauuugcaccauuugauuuugguaucuguagcuugcugcccucuuguucucauagcuuugcuuugaucagaucccuauuccacucuggauuagagaauuacauuuuaguacuuuucaaauauguaauagauacacuuuuuaucucuauguagauuuuaaacuacauaacaggacucuuugucauauugaauggucugcaguauugcuaucugaaauuaccgauaauauuguacauucagauucacuuaagagguaaccuugcagagaauuuacuucugugguauucuggaucacucuaaagagaauguuuuauaaauuaaacauuuuuaagguaaagauauauuuuguuuggcauuaguuccauguuggauugauugcuuuuuacugaaagcauuccaucaagcugaaacagucuuuuguuuuauguugcuuagaacaucaagcuugcaguggcuuucauuuucuuguuuuuguuuuuuuuuaaaucaaaucaaugcaugugcauaauuuggaaacucaaguaauauaagacauauaaccaaaaaaaagcaguugcuagcacaacccuccccauccucauucauggucccaagaggcaaucguuuccagucuguuugacuauuuuuuagcuuguacugcugucuucuuucucucuucaguuuagacagcaaccguuaacuuccugcuauggaaaaugaggauuucauugucuuacuccaacacugcuacauauuucucuacccucuuccccaucuucccucuacuaauacagcaugauuuuuagugaaaucuguauucaguguauacauuauaaugacugaaaaauauuuuuugcaauuuaauaccuaaucgacugugaucacauuuccuuucuuuacagcuuacugcuuuccaugaaguuauuaacuguccuuuucauuucucuuaauuuucuguguccuuacacaggagcuauaaaaauccugcccaauauguuaaaauuucuccauugguuccauuucuguuucuuggagaaccccuggaccucuucauaugcuuacuccauucugaagugcucauuuucuaugugugccauacagcucucauucuguaaauuauucuuaccucuuuucuguguuagaaaccccauuuccugguuuccaugucaucuuucuagaguuuuucccccaauuuuaagggcccacaacucucagaggcuuguugggaaaaggagcaugcaagcuuuuugauaucuuaggguaagguuggcuggauauagaauucuagguugaaauaauuucuucagaauuuuuaagacauuucauuuaucuucuuuagcauagcuccugcuaauugcagugcauucuuuuuuuuuuuuuuuuuuuuuuuuuuuugagacaacgucucacuguguuacauaggcuggaguguuucauuuuguacagaugaggucucccuguguugccuaggcuggucuugaacuucugggcucaaacgguccucacgcuuuagccuccgagagugcugggauuacagacaugaaccacuguaccuggccugcggugcuguuuuuaucuucagucauucauuaugugcucugguuuuaagaaguuaagauuguuuugucuuuauuuuuauuuauuuauuuauuuuugagacaaagucucgcucuuguugcccaggcuggagugcaauggcgugaccucugcucacugcaaccuccgccucucggguucaagugauucuccugucucagccucccgaguagcugggauuacagguaccugccaccacacccagccaaauuuuguauuuuuaguagagacaggguuucaccauauuggccaggcuggucucauccugaccucaggugauccaccugccucagccucccaaaguguugggauuacgggcaugagccaccacgcccagccuguuuuguuguuauuuaaauuucacaguaauguacuuuggugucuuuuuuuuuuuuuuuuuuuuuaacuuuuuuuuuuccuuuaauucuuggcccagaugcuuacuggcacuuacucuagaaacacauaguccuucauugaguucuggaaaauuuucuuuaagugguucuuuuauaauuucccuccauuuuuuucucuaguuuuuucuggaacuccugauguuuggacacuaggccuccuauauuguuccuauaauuuucuugucuuuucuccuacuuucuauuugauugucuuuuuuuauucuaacuucugggaugguuuuuaauuuuuuucuucuaauucuuuauuaauaugccauguuuuauagauuugucuuuaaauauuuuuacauaauuuuguaacaaaauacaaaaaaagcaauuccuaaaaauuuagaaagucaaaugaaagcaaagaacuuaaguguguuuucaauuagagcauaaucauaccaagaaaguauuucaaguaacuuaaaaaauguuuuaugucccuagugguauauaccccaagaacaacaauagcaacaacaacuauaaaaugaaacaaaaucuuaagcuauuguuaguaaucauauugcuggugguaguguugguauuccuauucugaaguuauaguggaugugaaguauguuguauguguauacucuuuuacguauauuuguuguaugugaguaauuauaugauuauagagaacagggaucuuuuuaucagagaaaggugcagaugugagauugaaguaaaagaaaacuugugguucugcauuuguauuggaaauaucauuaugaacucgagaucuauauuaucuuuaaaaaauacaugcuggcugggcacaguggcucacaccuauaaucccagcacuuugagaggccaaggugaauggaucacuugaggucaggaguucaagaccagccuggccaacauggugaaaccccgucucuacuaaaaauauaaaacuuagccaggcaugauggcaugcuccuguagucccagcuacuguggaggcugaggugggagaaucacuugaaccugggacguagagguugcagugagccaaggucgcaccacugcacuccagccugggcgacaaagugagacccugucucaaagaaaaaaaaaaauaugcuuauugguuucaucuaucaaaaagaacaaaaaaaaaaaaaaaaggaauaauccaguaguagugaguaacccuagcucucagacuguuuucuaaguacuguuuucucuuaaaaggaugcaaggugucuugaagaaauggcugauuccagauucagaggaggaaauauaugaaucuggaaagucuugacauaccagaaaaaaacuaagcaucaaacacuacuagugucaugucaaaaggacuuaggaguguaauagaauagauucuuacugaucacagauaaaauaauuugagcaucagaaaggauaauaacaggcugggcacacuggcccacaccuguaaucccaagauuuugggaggccgaggcaggcagaucacuuggggucaggaguuugagaccagccuggccaacauggugaaaccccuucucuacuaaaaaauacaaaaauuagguaggccugggggcgggugucuguaaucccagcuauuugggaggcugaggcagggagaauugcuugaacccaggaagcggagguugcagugagccgagauugugccacugcauucuagccugggugacagagcgagacuccaucucaaagaaaaaaaaaaggauaauaacagcaaaaaauugaaauucauaacaaaugauaacuucuauucucauuguuuuaaaaacuaaagcccaggcacagugucucacgcguguaauugcaguacuuugggaggcugaggugggcauacucaggaguaugagaccagccugggcaacaugacaaaaccccaucucuacaaaaaauacaaaaauuaaccaggugugguggcaugugccuauagucccagcuacuugagaggccguggugggaggaugaccugagcccaggaggcagagguugcagcgaguugagaucgugcuacugcacuucagccugggugacagagccagagccagacccagccucagaaaaacaacaaaaacuagguaaaaggagaaaaaaaucaagcauuuaucuuucuucucuuauaugaucuauauuuugggacccucaaguagaugaggggaaguuucuguuuauaaaaauguuucaacaaauaaggaauaauagaauuaaaauauaaccauuucgcaacccucaaauuaggguugucuuuucuucuaauucuuuuuuuuuuuuuuuuuuuuuuuuuuuuuuuuuuuugagauggagucucgcacugucgcccaggcuggagugcaguggcacgaucuuggcucacugcaaccucugccuccuggauucaagcgauucuccugccucagccuccuaaguagcugggauuauaggcacccaccaccacaccuggcuaauuuuuuuguauuuuuaguagagacagggcuucacuauguuggcuacgcugguguugaacuccugaccucgugaucugcccgccuuggccucccaaagugcugggauuacaggcuugagccuguaaauccagaaaaggauuacagcccuuuucuucuaguucuuaaagugaauuugugucuaccaacauaauuuucaagagaccuuuauuauucccuaaauguuuuucuuuuuuuugugacauucaguucuuguuucauagauacaguaucuucucaucuuucuaaagcuaaugauuaauguuuuauuuucauuuucguuuuuucugcucccugcauuuuuuuuuuuuaaugaaaaccuuugucuauuugagucucucugguuagagacuuuccucaauggugaucauucacugauccagaaguuguaugugaggugaggcuugucagcucauaggguaguaauguagugauuuaguuuuuaacuaggagacccucaaauaucagugacuguucugagagcugagcagaguaaggaaauuaauagggagacucauugucaguguaagaauuuuauuucaguuuguuguuuguuguuuguuuuuuguuuuuuuguuuuuuuuuugguuuuuuuuguuuuuuuuuuagauggagucuugcucuguugcccaggcuagagugcaguggugcgaucucggcucacugcaaccuccaccucccagguucgaggaauucuccugccucagccucccgaguagcugggacuacaggcgccugccaccaccccuggcuaauuuuuuauuuuuaguagagacgggguuucaccaucuuggccaggcuggucuccaacuccugaccuugugauccacccgccucggccucccaaaguguugggauuacaggcgugagccacagcgcccggcccaguuuuguuuucaauaauagcaucucacccccacccuggcugcgucugcucaguauuccagaguccacgauauguaugguucagcccuccagaaaauaaagucuccugcauuuuuuuuuuuaaugcugcagcaagaauaggguccuggguucuuuuuuaguaugagggagagacagccaccuggcuacuugggauaggaaagaaaaucugguguuucaacuacguuuguacaaaaugucaaccauuucuuccuauuuucagccccaccauaugcuccugccuucacagguaccuguugccuccaauuucugaguguuuuccuuuaauuauuuuguuucauguuaacuccuuacaacaaguuugguggcugaauaaccuugggcaaguuguguaguuucucauauacuuuaguuuuaucguugucuguaaaauggagaugagucuucagauuauugugaagauaauuuguuuguuuguuuuuuggagacggaggcacgcucugucccccaggcuggagugcaguggcacaaucucggcucacugcacccucugccucccagguucaagcaguucuccugccucagccucccgaguagcugggauuacaggcgcccaccaccucaccuggcuacuuuuuugguuuuuaguagagacgggguuucaccauguuggcccggguggucucgaacuccugaccucaggugauacgccugccucggccucccaaaguguugggauuacaggcaugagccaccuugccuggccaaagauuaauuguuaauauacauaaagcgcuuaacaccaugccagguaccuuaguaaguguucgaugaauauuugcuuuuuguauuagccauaaucauucucaggcugcuuugucauuuacuuguuccacaaauucuuagcuuccaaaauuuuggugauaccucauuuccuauucucucuaguugccuuuguccauguagauuuuuugaggaagcuuggguaaauaaguguauuuuaaacuauuauguuuaaaucgaaguuccuuuuaucuguuuucuaauagaaacauuuaaauagcauuaagaacuuguagcaguauaaacaauauguuugagaaguacuauauugugaaaauauuuucacuuuuauacaguuuuuuacuuauuuacugucuuacuaaucuuccuaagacuuuuuaaagugaauauuuuuaaggcaguucuagaagaaugaaaacucuuaugauaucuguaauagaauugaauacauauuuaacuacuaaaucaauauauuuauuaauuuguccagauuucugcuaacaguacucggccugcucgcugguauaccaaacuuggauucuuuccugacccuagaccuuuuccucugcccuuaucaucgcuuuucagugauggaggaaauguugguuguguugauguaauuauucaaagagcauacccuauacagguaugauguauucuugaaacuuaccauauauuucuuucuuuugauacaauuaauuuguuuguuuguuugagauggaguuucggucucuugcccaggcuggagugcaauggcgugaucuugguucacugcagccuccaccucccggguucaagugauucuccugccucagccucucaaguagcugagccaccacaccuggcuaauuuuguauuuuugguagagaagggguuucaucauguuggucaggcugaucucgaacuccugaccucaggugauccacuaaucucagccucccaaaguucugggauuacagaugugagccacugugccuggccugauacaauuaacuugaauguuauauaugugacuuuuuugguguguguaacacauuauuacaguggauggagaagacaucaucuggauuauacauauuucgcaaugaaagagaggaagaaaaggaagcagcaaaauauguggaggcccaacaaaagagacuagaagccuuauucacuaaaauucaggaggaauuugaagaacaugaagguaaaauuaguuauaugguacacauuguuauuucuaauaugagaacaaagucuuagagacuuugaauuuaacauuuuuaaugaguaaauuguuuuuauuuugaguaguaaauugacuuuauuuuuuaguaucuaggguauucuuuuuugguguuagacaaagaauagcaacaagggacagaaauaucaggucuaagccauuuguaauauuuuuccugaauucuuaccuauaugauguggcuuuugcauuuuugucaugguaguuauuagcuuucauguguuauuaugccuggaacuaggaccuauuguggugucaauuuuaauauuaaaaaucaugguguuuugauguuuauaugacauaaauuuuauuuuuucguaucucccuuuuguuguugcugaagauuuuauguuuuucugcauuuccucaugauuuauauagauguaacauguucuauaggacauguaauuuacauguccuauagaacuauaaguuacauguccuauagaacuuacaguucuauaguuaucugcagaaauauugcuccuuaugcuuuauuugcuuaaaauuaucacuagaucauacuauuuucauaaauaaaugaauaugaaaucauucacaggcauaccucagagauacuguggauuugauucuagaccaccgcaauaaagcaaauauuacaguagagcaaaucacacgaauauuuugguuucccagagcauacaaaaguaauguuuacacuauagcauaaucucuuaaauguguaguagcauuguaucuaaaaaaaacaaugcacauaccuuaauacacuuuauugcuaaaaaaugccaaugaucaucugagccuucagugaguuguaauauuuuugcugguggaggaucuuuccucaauguugaugccugcugagugaucagagugguaguuggugaagguuggggcaguuguggcaauuucuuaaaauaagacaauggcauuugcaacauugauuggcuuuuccuuucaugaaagauuucucuguagcaugcaaugcuguuugauagcauuuuauccaugguagaacugcuuucauaauuggagucaauucuaucaaacucugcuuuaucagaauauuauguaauauucuaaauccuuuguugucauuucaacaauauucacagcaccuucgccaggacuagauucccucucaagaaacuacuuucuuugcuuauccauaagaagcagcucuguauuaaucuguucccacacugcuauaaagaauaccugagacuggguaauuucuaaaggaaagaagcuuaauugacuuacaguuccacauggcugaggaggccucaggaaacuuacaaucauggcggaaggcaaaggcaaagcaaguacccuuuucauaagguggcagaagagagagugcaggggaaacugccacuuguaagccaucagaucucauaagaacucccucacuagcacaagaauagcaugggggaaaccacccccaugauccaaucaccucccaccaggucucucccucaacacauggggauuacaauuugagaugagauuuggguagggacacagagccaaaccauaucauucugcccuggacccucccaaaucucguguccuuuucacauuucaaaaccaaucaugccuuccuaacagucuccgaaagucuuaacuaauuccagcauuaacucaaaaguucaaguccaaagucuucaucugagacaagacaaaucucuuccaccuaugagccuguaaaaucaaaagcaaauucuuuacuuccaagauacaauggggguacaggcauuggguaaauguucccaucucaagugggagaaauuggccaaaacaaaggggccacaguccccaugcaaguccgaaaccuagccaggcaaucaaugaaucuuuuuuuuuuuuuugagacagggucuugcucuguuguccaggcuagagugcaguggagagauacuggcucacugcaaccuccgccuccuguuucaagcaauucucaugccucagccucccaaguagcugggauuacaggugugcaccaccaugcccagcuaauuuuuguauuuuuaguagagaugggguuucaccauguuggccaggcuagucuuaaaacuccuagccucgcuggguggggugucucauuccuguaaucccagcacuuugggaggcugaagugggcagaucacaaggucaggaguugaagaccagccuggccaacauggugaaacccuguuucuaugaaaaauucaaaaauuagcugggcgugguggcacgcgucuguaaucccagcuauuccagaggcugaggcaggagaauugcuugaauccaggaggcagagauugcaguaagccaaaaucacaccacugcacucuagccugggcaacaaagcaagacucugucucaaaaaaauaaauaaaaaaaaauaauaaaaauaacuccuagccucaagugagccacugcacccaggccagucauuaaagcucuaaaaucuccuuugacuccaugucucacauccagggcaugcugauauaaggggugggcucccacggccuugggcagcucugcccuuuggcucuucagucuacagccccugcagcugcuuucaugggcugccauugagugacagcugcacagugcaggcugucagugggggaugauggcccucuucucacagcuccacuaggcaguuccccacugaggacugugggagguggcuccaaccccguauuucccucacaguuucccucccgguuucccuccuguacugcacuaacagagguucucuaugagggcucugcccccacagcagacuuguguguggacauccuggcacuuccauacauccucugaaaucuaggcagaggcucccacagcugaacucuugucuucuacauacccacaggcccagcaucacauggaggccaccaaggcuuagggcuugcacccucucaagcaauggccugaucuguaccuuggcccuuuuuaucaauggcuggagcuggagcaagugggacacagguugccaugucccauggcugcacagagcaguggggccuugggcccagcccacaaaaccauuuuucccuccuaggccucaaggccugugauagaagggucuacuguggagaucucugacaugccuuggagacacugucuccauugccuuggcuauuaacguuuguuuccuuguuacuuaugcaaacuucugcagcuggcuugaauucuuucccgggaaauggauuuuucuuuucuacuucaugguuaggcugcagauuuuccaaacuugcaugcucugcuucccuuuuaaauauagguuccaauuucaaaccaucucuuugugaacauguaugacuguguuucuagaaaaagccacaucacaccuugaacacucugcugcuuagaaauuucuuccacaggauacccuaaaucaucucucugaaguucaacauuccacggaucucuagcgcaggggcaaaaugccacuagucucuuugcucuaaagcauagcaagagugaccuuugcuccaguucccaauaagauccucaucuccaucugagaccaccucaggcuggacuucacuggccacaucacugucagaauuuuggucaaaaccauucaacaagucucuagggaguuccagacuuucccacaucuuccugucuucuucugagcccuccaaacucuuccaaucucugccuguugucuaguuccaaagucacuuccacauuuucagguuaucgguauagcagucccccacuccugguaacaauuaucuguauuaguucauccucauacugcuauaaaaaauaccugagacuggguaauuuguaaaggaaaaagguuuaauugauucacaguuccacauggcuggggaggccucaggaaacuuacaaucauaguggaagaugaaggagaagcaaguaccuucuucacaagguggcaggaaagagaguacagggagaacucucacuuuuaagccaucagaucuugugagaacucccucacuaucauggaacagcaugggagaaacugcccccgugauccaguuaccucccaccagguccgucccucgacacgugaggauuaccguucaagaugagauuugggugaggacacagagccaaaucguaugaagcuccuuaucauuuaaguuuuauugugacauugcaguaauucagucacaucuucaggcuuuacuucuaauucuaguucucuugcuauuuucaccauauaugcaguuacuuccuccacugaagucuugaaccccccaaagucauccaugaggguuggaaucaacuucugguaaacuuguuaauguugauauuuugacuucccaugaaacacuaguguucuuaaugguauuuagaauggugaauccuuucuggaagguuuucaauucacuuuacccauaucuaucagagaaaucacuauggcagcuauucuuuauaagacauguuucuuuuuuuuuuuuuugagauggaguuucgcacuuguugcccaggcuggagugcaauggcgugaucuuggcucacagcaaccucugccucccagguucaagcaauucuccugccucagccuccggaguagcuaggauuacaggcaugugccaccacgcccggcuaauuuuguauuuuuaguagagacgggguuucaccauguuggucaggcuggucacgaacuccggaccucaggugauccacccgccucggccucccaaagugcugggauuacagguguaagccaccguacccggcaagacauguuucuuaaauaauaagacuugaaaguugaaaugacuccaugauccaugggccacaaaauggauauuguguuaggagucaugaaaauaacauuaaucacucuauacaucucugucagagcucugugacagagacaugaagugagcacauacuguugcgaaaauggcgccaguaggcuugcucaacauaguuuccacaaaccuucaauuuguguuuuuaaaaaaaugcaguaucuaugaaacucagugaagugaaauacauuaaaacaaauauaccuauguuaacucacauauuacuguaauuaaacucuguaugacuuuuuuuuuuuuuaaacaugaguacacugguuucaaaauuuccuggaaaacuuauagcaggccaggugucaugggucacaucuguaaucccaacaguuugggaguccaaggugguggaucacuugaggucaggaguuugagaccagccuggccaauauggugaaacuccgucucuaccaaaaaugcaaaaauuaaccgggcauguuggaugugccucuaaucccagcuacucgggaggcugaggcaggagaaccacuugaacccaggagacagagguugcaaugagccgagaucacaccacugcacucccagauugggugacagagugagacccugucucaaaaaaaaaaaaaagaaaaaacuuuuagcaguuauauaguuucuuaucuuuaaaucucccuucuuuggguguuuuaugcuugguucuuuaguuuuaguugcuuuugaauuuacaguuuagugaauuaauaauccuuuuguuuucuuagaaaacacaacaaaaccauauuuaccaucacgugcacuaacaagacagcaaguucgugcuuugcaagauggugcagagcuuuaugaagcagugaagaaugcagcagacccagcuuaccuugaggugagagaguaagaggacauauaaugaggcuugaugauuauucaaggugagaagcuguuuuagacucucuggccaucacaggaaggaguauguugaaaugcugcauuucucaaaagggauguguacauuucugggauuuucagugaugugccagacgaguguggugguauguuuucaacuauauaccgaguagaggaugggaggguucuagaauuuuauauauuaauuaaauuugguuuaaaaugcaggcaaaacuuguuuuauuuuugucccuccuguacucugaagcaaaaaaacuuuuuuauuuuuaagauaaaacaaauaucuucaaaguaauggcuuaguuuccauguucuuagcuguuucucaaguccuuccuggaguguacuugauaauccucuacccuaaggguacuuggguagaaauguuuccgaagcacuaaacuguuagaaguagcauaggcuuuagaaucguggcacucucauuuuauuagcaaaguaaaugacaauaaaauagcuggccaggcgcgguggcucacgccuauaaucccagcacuuugggagaccgaggcagaaggaucaccugaggucgggaguucgugaccagccuggccaacguggugaaaccccgucccuauuaaaaauacaaaauuagccaggcguggugcacaugccuguaaucccagcuguucgggaggcucaggcaggagaaucgcuugaauccaggaggcagagguugcagugagccaaggucaugccauugcacuccagccuaggcaacaagagcaaaacuccgucucaaaaaaaaaaaaaaaaagcuauuaaaugggcguaaaauguuguuuuaggaucaaauaaauaaucuauauaaaaguuccauauaaauguuaguuacuauuauuagaacauaauuuuauauauuaaacuaccuccuaaauuuuuagacagguagauagcuaaaaaaaaauucaaauucuaagauuaguuuguuagggaggaaggagcaaauauuuuaccaaaacuacuuguuuuuaauugauuaauuucauucacuugaugacuuaguaaaucuugugaauauagccuuaaauuucuuaaauagugggacuacaaaauaaacaauauuucaucaguaauguaagcagugcuauacugaguagaauucccuccuguuccgaaauguuacaauuuggguucucccugugagaagugaguccgguuuuaaaaccugugaguauacuugcugcaggucugaaaaugaaggcuuuaugauucuuucuugaaaaauuauuugccucuaucuuuuauaauauuauuuguugaagcuugugcauucuaugaaucaucaugaagauagcuuuaauuucauccacaaaauuuaacaauauuuuuuugucuggacauaagggggcagaauaagaguuggaguagggccuugcccagccacucuguaacuggacaagugauguauuuauuucuuaggaccucauuuccaccuucuaucaagggaaaaccuaagaguagguuaucuuuaggguucuaagugccuaugagucuaugagauuugacuuuauuaaaguuaucuuuguaauucuuugaggagaacguaggcauccauuuuuaaaacaguccuguuagaauuuguuuucaguaacaauguugaaugauggccuuuugaaaucagguuuuacaacaaaauuguuuaaacacugccugcauauuuagaaucucuauaccuauauuaagauacagagauuggauagucucccuuuucaguauagauaaucucccuucccgguagagauuaggauauuaagauguauaauauccuaaaguguagcagcagucugguauguuacaugucuaaauuccauuuccuauuuuauuuguuuauugauuuaucuguuuauuuuuguuacacuggguaagauucccaagagguacaaguagaaauuugcuaaagugaguaggacagaaguguagaggcaaacauaaaaguauguuuaguacauaucuguuuuaaauuguaucuacuauuucaaaguuaauggaauuauacuccuggggcuaagaaugaggguucuagggccaaccucuacuaccuauguggcuugugcaaauuaguuguccccuuugugccucaguuuuaccuacaacacagaaacaaugauauuaccuaccccauggacuguugugaagauuaaaugaauuaguacauuuacuacacauagaucuauuucucaaaauaaugagcauucagauauuagccaucuguaauguaguuggugaugauuaugauuauuagaguacauuuauaauuggaggaucauuuuugccguagggaaauagaauuauuaauaguuugaggcaccugagaauauuaugugagaaacugauuacauuaaccacacccuuaagaugagcucuaauuuuguuguauuuguccuguuuaaagccaucuaguuacaauagauggaacuuuuuuguucugauugcuuuuuauuccaauaucuuaaauggucacaggguuauuucagugaagagcaguuaagagccuugaauaaucacaggcaaauguugaaugauaagaaacaagcucagauccaguuggaaauuaggaaggccauggaaucugcugaacaaaaggaacaagguuuaucaagggaugucacaaccguguggaaguugcguauuguaagcuauucaaaaaaagaaaaagauucagguaaguauguaaaugcuuuguuuuuaucaguuuuauuaacuuaaaaaaugaccuuacuaacaaaaugauuauaaauccagauaaaguauaaaguuaguuuauaucagagaagcaaaauccacuacuaaugcccacaaagagauaauauaaaagaggaucuguauuuauuuugaaacaaacauuuaaaugauaaucacuucuuccauugcaucuuucucaucuuucuccaaacaguuauacugaguauuuggcguccaucaucagauuuauauucucuguuaacagaaggaaagagauacagaauuuaucaucuugcaacuucaaaaucuaaaaguaaaucugaaagagcuaacauacaguuagcagcgacaaaaaaaacucaguaucaacaacuaccgguacaaaccuuucauuguaauuuuucaguuuugauaagugcuuguuaguuuauggaaucuccauauguugaauuuuuguuuuguuuucuguagguuucagaugaaauuuuauuucagauuuaccagccacgggagccccuucacuucagcaaauuuuuagauccagacuuucagccaucuuguucugagguggaccuaauaggauuugucguuucuguugugaaaaaaacagguaaugcacaauauaguuaauuuuuuuuauugauucuuuuaaaaaacauugucuuuuaaaaucucuuaugauuaguuggagcuaccaguuggcaaauuugcuagcuaacuagugaucugaaaguaagccucuuugaaccucugauuuuucaugaaaagcaauucucucaauucuauauuauuucaaggguaacaaguuacauccuagucuguguacuuaauuuuauagaaauuguccuuaauuuuauuuucugcaauuuauguuuucuuacuauuucugguguauguguuuaucccauugugauguuauauugguguccucaauuuauuuccuuagccauacacucuacuuuucauuguacagggcuauuuauuaucucagagucaagcuuuuuuuuuuuuuuuuuuuuccccgagauggagucucacucuguugcccaggcuggagugcaguggcgcuaucucagcccacugcaaguucugccucccagguucacaccauucuccugccucagccucccgaguagcugggacuacauauacccgccaccgagccuggccaauuuuuuguauuuuuaguagagucgggguuucaccguguuaaccaggauagucuaaaucuccugaccucgugaucuaccagccucggccucccaaagugcugggauuacaggcgugagccaccgugccuggccagagucaagcuuuuauuuuauugaauauauggucuuacuaaguucaauagcaugaaucuguugugaagaauucaagaauuuucuucuauuuguugaguuuuguuuucuuaggaguuuugcucuuucucuuuugcuguguuuucuccuuauuuuuuaaauguguuuguguuuggugaguuauguuuuagugcuucguagguuuuucuuugacuauauuauauuaguaagccacauuguucccaugccauuuuauuucaucuuggucauauuuggaugacucuuuucacacauuuuauuguuauuauagaagguggauaacuuuuguucauuuaauucaucaauauuuauuuaaugacuguuaugugcuagacaguguuuuaagugcuggguacauagcgauuaacaaaacagauaagaaucccuacccucauagagcuuacauuaugagguugggggagggagauuacaaacaaagaaauaaguaauauacauguguauaguuuuuuuagugcucagaaaaaaaauuaaguggguaaggggguaaugucagagaagagagagggauguaauuuuagauugagaggugaggagagagaccucccuggaaagcugacauuugagugaagcuugaaggaauugagggagugaggugaggcauguggccaucuggggaaagcuuuccaggcaauuacaaaggccgcaguacagcaggaucaugccuagugugccgugaagcauuggcagagaccagagagugagaaguaacauccagggacagaggcagugaagagccaggucguguggggguccuuguguggacuguaacuuccugugaugacaggaagucacaggaaaauuccagguagagggacacugucugacagguuuucacagaaucauucaggccacuguguugagaauaggcuguagggggcacaagaguacaaacaagccauuuggaggcucuuucaagcacuuaggcaaaagaugaugaaccaaacaaaagcaauggaaguggugagaagcagucagauucuuguuguauuuugaagguagggggacggugcaggauggucugaacauugggaaaaauggaauugccacuuagaaggaaagacugcaagaaaagcaaguauguggggaaguucaggagcucaguuuuagacaguuaaguuuuagaugcuuauuaggcaucuaaguagaaaugucuacuugaugguuacauaggaaucuguucagaggaauggcuggauaugaauuugggagucuuuacuacaaauuuuuuuguauuuuuaguagagacgggguuucaccguguuagccagaauggucucgaucuccugaccucgugauccacccaccuuggccucccaaagugcugggauuacaggcaugagccacugcacccggccagucauacaggggacauuuaaagccgugagacuggaugaggucacugugggcaugggaguagauagagacgggaagagauccaagaccugauugaagccuuuuauacuuagaagcagggaaauauaaauguaaauauaggaaucaguaaaagaaacagaggaauggccagagagguuggaggaauacuggagugagguaugcugaaagccaagagaaaaaaagaauugucgaguagugagagugauuaagucugccaaaugcuauuucauagaauugauaaugaagugaggaccaagaauugaucauuggcuuuaacaccguggaggagcacuuucaguggacugaaguggggcaaaggaaauggagggaaaggaggaaugauagugaauauaggcauuucaaggauuuuugcuuuaagagaagaagagaaaugaaucaguagccagaaggggaaucaggaucaagagaacauuugcuuuuucaguugaaagugcuaauagcauacugaugagauacuguaugcugaugagaaagauccaauaaagaagguaaaaugcaagauggaagcaaaacaggaacagcuguggggcacuguucucagauacugugugguaugguaucuagaggcucuguugaaauuggccuuagcuagcaggagagacuguucaucuguaaucacaggaaaaaaguaaaguacguagguauagauaccaauggaagaguugauauacaagaggaaacuuguggcagaccucuuuugauugcucuauuuccucgcugaaacagggcacaaaaucaucagcugagagucagaaugaagaaaagggggccaggcgcgguggcuaacgccuguaauccagcacuuugggaggccaagguggguggaucacgaggucaggagauggagacaauccuggauaacacggugaaaccccgucucuacuaaaaauacaaaaaauuagccgggugugguggcgggcgccugcagucucagcuacucgggaggcagaggcaggagaauggcgugaaccugggagguggagcuugcagugagcugagaucacaccacugcacuccagacugggagauuccgucucaaaaaagaaaaagagaaagaaaaggguguugaagguuugagagaagaggaaaggcaugaaaucauuaucuaagaaagugguagaguaaauggacuaaguaaacacaucaugacugccagggcccacuggagguuuaauguucaugaauauauuguuguugugugauauuuuuucaaccguguucagcucugauggugugggcaugaaguaguuggaaaguagaauuuaaccaggucuguaguuuagcuggguaaguaaugcaaagcaagaagggcaaagaauuuggggguauaugcaaaaggaggauuuaaauaauugaccuuggacacaaugcagagcaaagaagagacauuagaagacguggaucaaugaacaggagauaagaaaagcugauuguaggucacgguggguuugaguuaggguuuuagagggagugaacugggcagaucaaagguaggugguugaagaaggagguacuucaaauugagauucugggggaaauggaguuauuggaaauaaaagucuuggguauguccauugcagugaguuaccaguggaaaauagaggacaugaucauuuaggaagaaaacaaggaacuugggagcaacagaguauuggaaggauugccugugaggauacugaaauuuccaggaaacaugaccaucgugaugacagaaugacagugaguuaugaguuaaaaucuucaaggaaugaaaggcaaugagugagccagggucaauggaugccuguagcaaggaacaguaaugaaugacagucugauaacacgagguucaaaacugaguguuuuuagagugggaggagcagcaaugaagcaugaggaagacaucugccucaucucagccuccaguagcacaaggucugcaggggcaacuguacaggcagacaagaaccagguuuguugcaacaagauggcaaugagagcaccugcaggaaagggugacgguaguggagaucuuacugaguuccagaggccccauugaaaggauucgaggagaugaagagguaggaggagauggugcccagaaaggccacauccaaagccuggaagcggaauccagggaauuuggcaugacugagagccugugcugccuuuuuuaaauguuuuaauuuuuguguguuuauagcagguguauauauuuaugggggagccugugcuuguuauggggacugacacagaucagcucuuggccccaaggcaaggugugugggagaagaaaaagugaggaggccuagaugucagaggaguccggcuaaaccacugcagaacugcugccuaauucacagcaaccaugaguaaaaaugcugaugaucaucaggucaaggauagucuggagcaguuaagauguuacuuuacaugggagguaucaauuaaagaugaugaaaugccugauuuggaaaacagagucuuggaccagauuggguuucuagacuaaauacagugugggaauacacaauacacaaccuacuagccuaugugaaacacccgaaaggccagaaugaggaagugcuggagaacuugaaagaagcugaagacuuaauccagaaagaagaugccaaucagauuugagaagccugguaaccuggggcaacuuugccuggguguauuaccacaugggcagacuggcagaaacccagacuuaccuggacaagguagagaacauuugcaagaaguuuucaaguccuuucugucacagaauggaauguccagagauggacugugaggaagaacgggccuugcuggaauguggagggaagaauuaugaacaggccaaggccugcuuugaaaaggaucuggcaguggcugcugaaaacccugaacucaacacuggguaugaaaucaccgccugucgccuggauggcuuuaaauuagcaacgggggaucacaagucauuuucuuugccuacccuaaggcaggcugucaggcuaaauguagaugauagauauaguaagguucuucuugcccugaagcuuugggaugaaggacaggaagcugaaggagaaaaguacuuugaaggagcucuggccaauacguccaugcagaccuuugucuuuggauaugucuuuggauaugucuucucuucuuacugaagagaagacuuuguggaugaagcucuugagcucuuaaaaaccuccuugcaggcaacucccacuucugccuuccugcaucaccauauagggcuuugugacaggacacaaaagauccaaaugaaggaagcuaccaacaagcagccuagagggcagaacagagaaaagguagacaaaaugauaagaucaccuguauuucaucuucaaucugcuguggaacaaaagcccacauuugagguugccuauauagaacuggcaggaaaguauauagaagcaggcaaucacagaaaagcugaagacacuuuucaaaaaguguugugcaugaaaccagugguagaagaaauaaugcaagacauauauuugcacuaugguagauuucaggaauuucaaaagaaaucugaugucagugcaauuauccguuauuuaaaagcaauaaaaauagaaaaaggcauaauuuucaagggauaaaagugucaauucuuuggagaaacugguuuuaaggaaacuucagagaaaugcguuagaccuggaaagcuuaagccuccuuagguuucuguacaaauugaaaggaaacaugaaugaagcucuagaguacugugagugggcccugagacuggcugcugaguuuuagaacucugugggacaggguccuuaggcacucaaauauugaccacuuucauauuucauuugauuuucuguuaacgugcuaaucaaggcugaggugaguggaucaccugaggucaggaguucaaaaccagucuggccaaaguugcgaaaccgcuucucuacuaaaaauacaaaaauuagccaggggugguggcacacaccuguaaucccagcuacucaggaggcugaggcaggagaauugcuugaaccugggaagcggagguugcagugaaaugagaucgcaccacugcacuccagccugggccacagaacgagacugcaucucaaaauaaagaaaaaaugauaaucaucuuuucugcuugcuguuuucagaaacauauuauguaauucacuguaaugauguaauuauugaacaguuacucaaaucugauaaaauauuaguugcauucaauaauuaaugaaucaaugugugugugcauguaagaaaaaccauuuguaugaagcagaaaaaaaauguuagguagauuuguaggaaacaaaauacuggacuuacacuaaaauaaagugagaaggucggugccaugacccaguguaauucuugacucucuauuuauccaagauuaauuucucccccccuuaguuacagugugagggcuggauauuugaguuucuauucaugauacaguauguaucccuggaagaugucucugguucuagaucauuuuucccaguucagugaguaacgccguguauuuauuugcuauaacaaagaaccauagacugggggcuuaaacaacagaaauuuguuuucucacaguucuggaggcuggaaauccaagaucaaaguguuggcaggguuaauuccuucugaggcugugagaaucuguucauugccucucucuuugcuucuggugauuugcuggcauuuuuuggcauucuuuggcuuguagaugucucaccuccaccuuugcuucauuguaaggugguggucucccaauguacaugucugugucuaaauuuccccauauauuaggacaccagucauuauauuagagccugcccauauguguggguggaggauuacccaggugccgaggcaagagacugaaggcacaaacuauuucaguauaauaaagaaaauaguuagauuaaggauagucauaauacaaauuagauauagagaugaucauggacaauuagcaaucauuauaaaccuuaaucauuagcuuuuaguauuauucuuugcugcauuacuaauauaaccuaggaauaacuggcggguauagggugaggugcugaagggacauugugagaagugaccuagaaggcaagaggugagccuucugucacgcccgcauaagggccacuugagggcuccuuggucaagcgguaacggcagugucugggaagacacccguuacuuagcagaccgcaaaagggagucucauuuccuuggaggagucagggaacacucugcuccaccagcuucuuguggaagccuggauauuacgcaggccugcccgcagucauccggaggccuaaauccccucccuguggugcugugcuucaguggucacacuccuuguccacuuuuaugcuucucccguacucuugguuccucuuugaaguucguaguagauagcgguagaaggaauagugaaagucuugaagucuuugaucuuucuuauaagugcagagaagaaaacgcugacguaugcugccuucccucucuguuucggcuaccuaaaaggaaagggcccccuauccuguaaucacgugaauugcuucaccuuuucaaucacuuagaagauucacccuccuuaccaugcccccuugucuuguaugcaauaaauaucagcaagcccagccguucgggccgcuaccggucucccgcgucuugaugguagugguccccuggguccagcuguuuucucuuuaucucuuugucuugugucuuuauuucuuacaaucucuugucuccgcacacgagaacacccgcuaagccgcauagggcuggacccuacacauaugaccucaucuuuuuuuuuuuuuuugaguuagggucucacucuguugcccaggcuggagugcaguggugugaucucagcucacugcagccucugccuccccagcucaagcaauuauugugccuuagccucccgaguagcugggacgacaggcacgugccaccacacacggcuaauuuuuuguauuuuaauagagcugggguuucaccauguugcccaggguggucuugaacuccugagcucaggcauucugcuugccucagcaucacaaagugcugggauuauaggcuugagccacuaugcccagcgugucuuaggauuuuucaacuuuauaauggucugaaaacaaaacaugaguaccuuacaacuauucuuuuucacuuccaguacaguaugcaauaaauuacaugagauauucaacacuuuuuuuuuuaaaaacaggccuugcguuagaugauuuugcucaacuguaggcuaauauaaguguucugaacacauuuaagauaggcuaggcuaaccucuaugcucaguagguuaaauguauuaaaugcauuuucuuuuuuuuuuuuugagauugaaagucacauuuauugccacgugaaggaaagccaauuaagucaaauugauuaauguuugcagaguauaucuguuucgauccuuuuguuuuuaaucuaccuuugucgaauuuaaagugaguuuccuauaaggaacaaauagucggguuauaaauuuuuauccacucuuucaaucucuguccauugauuggauauuuacaucacuuacaaugaagguaauuauugauaugccagcauucaacuuugucauuuuauuauuuguuuucuauuuguuucuccugcuuuucauuccuccauuucucuuuucuugccuuccugaagguuacuuaaauauauuuuaggauuccaucuugauuuauuuuuaguguuuucaggcauuuuuguauuauuuuuguaguuguuucucuagguguuacaacauacauguaugacuuacagcagucuacuaguaucaauauucuaccacucuaagugaagugugagaauuuugcuuucauuuugauuuuggagggaaagggauuggauagugaccauauacagaccuuuuucuucccuacuuuuaaauacuauuuucuuggauaucauaguauuauuauuuuuguuuuagucaucaaacauaauuuauaaacugcaugaggaaaugauagcuuaucguauauguccauuucucaaacucuuuccauuguuucuuccuccauccuauuguccucaguccugaugcucugagagucuuccuuuaaucuucucuuuucuguuuaaacaauuucuuuuaggcaauuuuugaguuagagaaaauucuuuuaguuuucucucaucucagaauauuuuauuucuccuuuauuccuugagaauuguuucaggauauagaauuuguaguugauaauucuuucuuucaguacuugaaaaauauugugccacuucccucuggccucugguuuuagaugagaaaucugucaucauuccaauugaugugucccuauuuaaaugcauuuucaacuaacaacggguuuauugugacauaaccccaucauaaguuguccucgacuguguuuccagauaaggcugcauucacagguacugggaauuagucacaauguauccuguaacauccuggaaccuuuccuuaugucagucaguccuggucaccuguuuggucccuggcaguuuuuucucauuucuguucagaagaagaaaaagguaaagauucuucagauuuaggaauaacagaauucucaaaaaugucauuuuaccaguuuaguuggggaaggagauuagacucugagccuuccugugcuuaguucuauccauaaucuucuguuucuuaaucaccagauuuuaaauuuuauaucaugauauuccacguuuguagauuuugggugaauguuuccuuuuuaaaauuuaauuuguuuuuaaguguuaaaguucuauuagaaaguuucaaggagccaccuuaaaccagaagucuuuaacacccagaucuagucaugaugccucccagcuuaaaaucuucagugguccccugucccuuagaaaaugaaacccagacucuuuuguauacccccaaaaccauucaacuuccugccuuaaaccaccaccauacacacgucagcuaaacucuaauuuuaggcugggcgcaguagcuaaugcuuguaaucccaggacuuugggaggcugaggcggcucgcaaggcuaggaguuugggacaagucugggcaacagugagauucugucucuauaaacauaaaaacuaaauuuaaaaaaaaaacuacuuuaaaacauaauaauaaaacaaacuguacaaguucauauuccugaugcaugauaacauuuaaugcuuccuaccuuuaaaaaucuucuuuguuuugcauagaugcucuuuuguucucccccucuugaugaauuuguccuauucauuauucagcucaaguauuaccucccuagucagaugcuuacagucuggguuagauccuccuuccuccagcuuuugaagcauuuuguugguuuggcuguuucagcacuugucacaugguccaugauccuaccuguacacuucugaauaagccaccuacuagccucaguaauacaaugaucucuucaaggacagggacucuguuuggauuucuacuuccacuucugacauaauggguugaagcaggggucaguuguugaaaacuccagguaugcagcaucucauacgguccucauagucacacuguucauuugcuauuaucaucccacuuuacagauggggaaacuggagcucagagagguuaaguagccugcucagggucacaaugcuauaaauugauuugaacuuauacuuucaggcccuaaagcucuuagguucuuucuuauacuucaugcugacaaaacaaaagcaaacucaacauuugagaguugggcuuaaaacagggacaucuguauuuuuaaucuaaugcuuuguuacuguauuacagaaacacugugauauauaaugaguuaauuaaacgagaaccuuucuuagguugggaaagauuuguuuuggggaaagccuguuucccugggaaacagacuuacagauuucauguaggagauuagaaaaugcccuuaggaacagcacuugugaggaagcaaaugcagcaggauugggcagaagaagaagaaagguucaguuagucccacagggacuucuggagcuggguggcccuucagagucuugcuagccugaggcaagagccaguccuugcauacuggcuccuccagggaggggcauagccuuaagcaagacaaugccuuucgacagagggcaaguccaggagggaacucagaggugaguugucaauagcuagcucuccccagaagcuggaggaucacaugccuugguccugaaggggaucugcacccgcaccauggcauccacuccagguggaaucggugacagugguuuuauaaauugcuaaguccuuuauuguuucagugacauuuucuaaaaggaauuaaaagcuuugaagaauucuaugcaaguucagaguaggccagaccacaaagcugcaaaauaaguuucuucuuuuccuuuugucuugugaagauuuaccuaguguaggauucuaaaaguguuacacuaaaaauucuuccaguuguuaucaguuguaugauaauuaaagaaauaaggcuuccauuucuuuugauggaauuugauccagacauggaaaccuccacuuacguaaaagugcaaugaggaaacuacacuguuuacuuuuuauuuuucuguauucuaaauguuuuucaauaaacauguauuuuauauuuggggaaaacaagauauauuuaaaaaggacauuugggagaaggacaguacuaucaucaaguuuugaauauaauuagaggcaaguuccaaaauuagaaaauggaacaugcuugagaaacuuauaauuucuuuaaaagcaguguuuaaaauuaagauccauuaaauaaauuugaaaugaaaagaaagaaaagaugaaccaucauuugcaauagaauaaacaaauccuuaucugagaaugacauuuccauucccuguuauuuacaacggauacauaauucucagaguaacaaaaacaauaaaguauaaagaguagaauuaaaugcuuagugccucuuccaacuccagcuuuccuagccucaguucuauccugguuuaucccaggauagaauggauagcaccuacccaucuuucacuuuagaauuuuauaacucuuggcuaggcacaguggcucaugccuguaaucccagcacuuugggaggccaaagcaggcagaucacuugaggccaggaguucaagaccagccuggccaacauggcuugaacccgggaggcgggggcugcggugacccaagauugcaccacugcacccuagccuaggccacagagugagacugcgucucaaaaaaaaaaaaaaaaaauuauaacucuuuauuuugaacuaauuucagaccuuuaaacaaguugcaaaaaucguggaauuuccaaauauuccucaccuagcuuccccuaauguuaacaucuugcauaaccguaguacaauuagaaucagaaaguuaauagugguauaauuauuacccauacuguagauguauuugaaaaauuguuugaguuuaagguauuuuacccuguuuccccuuuuuuguucugggaucccaaauugcauuuagucauuuuuccccuguauuuucuaccagucuuuaauacuuccugucuucuuuuucaugaucauuaugcuuuugaauagacugauaaugaucauuauguuuuugaauagacugaucaauuauuuuguagcauuccccucaauuugaguucgucugauguuuucucaugacuaggaugaaguuaugcauuucuggcaagacuaccacugaagugaugaugugucuuucucaguacaucauaucaagggguuaaugauacugaucuuaaucacuugauuaaggugauaaucugcuggguuucuccucuguacaauaacuuccuuuuucuuuguaguuaauaaauaucuugagggagauucuuugagacugaauccuauuucacaucaaacuagcauucaucaguugauuuuguuugcaacaaugauuacugugguauuugccuaauuaugauuuuucucccuuucuuuccuucuacauuaauuggaauucuauaaggaaaagcugugcccuuuccaccaauguauuuauuugguuauuuauaucaguauggacucaagaacauuuauuuuauucugcagguuaaaauuugguaccuucauuauuuuauuguuuaacuuuuuuuuuuuagcuuugaccauuaggagcuuucucauauggacucguguguucuuucaaccagcuuucuucacuuuuugaacacuuccuuauuuuuugacaucacaagauguuccaaguucaucuuauauguucccugcccuagucuuggaaucagccauuucucuuggcuucuuuuuuuuaguagaaaaugguguuuagauccaagaucugguugcuagauaggcucauuacuuuacuguggaggcaucaguacugccaggcccucucagcagacagaggugggaaauguuugucuuccauuuuggauucccucaugucuaguuggauuuguuuguugguugguuuauuggguaugugaaguaucacugugguucuagggagucagaccuguacaaaaagauauacuucaugucacuuccuccuuauccuugcagucccaauccuaauccuccuuuuucccccacucacacccuguuccuuuaguuucugaguuuauccuuccugauuucuuuugcucaaaugaacagauacauguguauuuucuuauauucccuucuuccuuauaagaaggggaacauacucuagccuuucuuuuaugcuuuucuuuuuuaacucaacacuguccuggagaucaguucauagaaaucguccucacucuuuuuuuacagcuacgugguacaccauuguuuggauguaccacaguuuauccaacucuauccuguauaugagcuaauaaaaguugcuuccaauauuuuauaauuauaauguuucagugaguaaccuuguucauagguguuuucaugaacuuuauguucauguguauuuuacuauuauuagaggucuaucuucagagaggaguacaagaaaugggauuacugggugcaaagguaaauggauaugugucuuugcuagguauugccaaauuuaucuccagaaaucuugcacaaaucuguacuccuguuagcaaugugugcguauaccugcuuccacaugaccucaguaaaagaauguguugucauauugguauugaaauuuuagcacuguaagcaacaggucauuuuggaaaaccugagcuuucgccaaauucagcuauuuugauuugcuuuuauuauuagcauauaccaaaauaaauaggcauauuagaguuuccuuucuugcaucuuaaaauucaucuaacacaucuauaauaacauucuuuucuuuuuuuuccauucuaggacuugccccuuucgucuauuugucagacgaauguuacaauuuacuggcaauaaaguuuuggauagaccuuaaugaggacauuauuaagccucauauguuaauugcugcaagcaaccuccaguggcgaccagaauccaaaucaggccuucuuacuuuauuugcuggagauuuuucuguguuuucugcuaguccaaaagagggccacuuucaagagacauucaacaaaaugaaaaauacuguugagguaagguuacuuuucagcaucaccacacauuuugguauuuuucuauuuugacaguccaguaucaaggaaauagcuuuuauacaaauuggauaguugagguaguaugugagguaaaguuuaaucauauauuaauugcccaugaaccucaggagaugggggaauggggaaaugacagcaacuagaaagagaagaaugacuugaagggaaaugaguuaggagaaauugugagaaggauguucagaaaugcagacuuuguaagcaaacuggaaauugguuacaagaauaauaugaguuaucugugguuugcagcagucagcagugugauuaguuaauaauauagagacuacagguuuacauuuaaacuccauaucuaguguuuuauacagauuauauuucuuugacuugauuuaaucccagauaagagacacugauauuauuuucccuagaucauguaugcauuuucugcuuaaaucuauauauacauuauauaauauuagcugguguuuauugaguguuuacuaugugucagaccuuguucuaagcuucucauuuaauucucccacaaccuuaugagguagggaacuguuuuucuauuuuaucagugagaaacagguuaaauggcuugccuuaggucaaaugccaaguuaguaaaacuaggauucauacuuaggccaucgaaugcagaacccagacuaggaacugcuaugcaaugcugcuucccaguaaaauuugagauuucaugaguugguaacuagugaagaauacacaaaaaauaagccucuuaauucuguaguuuaauauuugaaauguguguuauucagaauuuauauaaaaauauauuuuaaaagcauuagaguagcuguauaaagaaagcuguguugacauuuuaccuagagacucuaugcauaaugaauaacacucugcuauaucuaguuucuaaauuaggggugggaguuguauucauuauuuaguucccauacagcauaucuacuguuuacaccccacauuuucuuuuuuucuuucuuucuuuuuuuuuuuuuuuuuuuuuuuuuuuuagagacagagucuugcuuugucacccccaggcuggaguacaauagcacaaucucggaucacugcagugucugccuccugggcucaagcgauucucgugccuuagccucccaaguagcugggacuacaggugcgugccaccacgcccagcuaauuuuuguauuuuuaguagagacaugguuucaccauguugggcagucuggucucgaacucuuggccucaagugaucugcccaccuuggccuccccaaguacuggguuuacaggcaugagccaccgagcccgcauuuucucugagacgucuucaaaggcaguuuacuaauccugcugaagagacaacugucauuuacacagcauuuuaaaguuuuacaaaauacugucaugaauuagguuaaaccauaugaaauugcugauauuugaccaguugugauuucucaagcaacaguuucauguaguuuaaccuauaaaucauuucaauuaauucuuggaacagacgugagguaggugaggcaauucuuucuuuucucuaaccaaagaaguaccuuuauagaugugagaugauucccagcuauuaaguaguaaauagagcuaggacuugagccccaaucuuccagcuucaauccagaucauaugacagcuugcugauuaaacuagaugacagagaagaucucuuuccuucagauacacauacuuuuucucuguuccccucucccuaucagcuagauuccccuaaaucacugauacugguuuuguaauuuugcaucggcauguuugacaauugguaucacauuuaggguuuuucauucuuuuuugguccaaacuuuucauuucugcuuuuaaaggaaauacuuuuggaaacauaaauauguggguuugcaauuuauaaagcagcuuuuccacuuauuuucuuagaauauugacauacuuugcaaugaagcagaaaacaagcuuaugcauauacugcaugcaaaugaucccaagugguccaccccaacuaaagacuguacuucagggccguacacugcucaaaucauuccugguacaggaaacaagcuucugguaaguuaauguaaacucaaggaauauuauaagaaguauauauggaggccaucguauauucuguuguauaccuaguaaacaugguaaaauguaauuaaacuuaauuagaaaaugugguuguuauguggcuccuguaaguauaguuauuuagaaauuuuauuuauugaagcaagauaugaaacucugggugcacacuuuccaaacaggugcuuucauuuacaugugauugaaaaguguuuuuugucauuuauuucacuguuccauacaauuaggguuguuucuaagcuguuuguaagcuguuucuaagcuauuuaagugguuaaaucacaguagaugcaaaucaagcuaaagucuuuaacauuggcuaauggcugauucuuaaauagcuaauacuugcuaaggguaucuauauuaacucauuuaauccucauaacaacccuaugagauaaaaccuaaguccucacuuaacauugucaauagguuuuuggaaacugauuuuaagggaagugauguauaacaaaaccauuuuuuuuucucaucacuguucuaacaaaaugauguugaagauuuaaaugacauugcucaaagaccugcuauacauuguuugacuuaaagucacaguuuccgagaaccuaucaauuauguuaagugaggacuugacucuauuauccugauuuuguagaugaggagacuguggcauagagagagguuaagcaauugccuaauaaggucacaaagcuagaaaaguagguauuagaacccagauaguguguguucucaagauggcuuuaaaauauuuaucuuuguuuaaucuguuaauaauaaaaaacaaaagauuaaagcauaagugacguccccuaccuccuuuuuuaucuuuuacugugauuauucuucaucuuccuuccuuuucaugucauuuuauauguucuuauguaaaauuacuuucaucuagaauaggaauaaugugaacugaaaucaccuaaccuauuaggaguuaggggagggagacuguguguaauauuugcgugcuuaaauauuuucaaugaaaaguuacuuugauuuaguuuuuuauguuacuacauaauuaugauaggcuacguuuucauuuuuuuaucagaugucuucuccuaauugugagauauauuaucaaaguccuuuaucacuuuguauggccaaaaggaagucuguuuccacaccugucucagcccagaugacuucaaagucuuguaaaggggagaaagagauugaugaccaaaagaacugcaaaaagagaagagccuuggauuucuugaguagacugccuuuaccuccaccuguuagucccauuuguacauuuguuucuccggcugcacagaaggcauuucagccaccaaggaguuguggcaccaaauacgaaacacccauaaagaaaaaagaacugaauucuccucagaugacuccauuuaaaaaauucaaugaaauuucucuuuuggaaaguaauucaauagcugacgaagaacuugcauugauaaauacccaagcucuuuugucugguucaacaggagaaaaacaauuuauaucugucagugaauccacuaggacugcucccaccaguucagaagauuaucucagacugaaacgacguuguacuacaucucugaucaaagaacaggagaguucccaggccaguacggaagaaugugagaaaaauaagcaggacacaauuacaacuaaaaaauauaucuaagcauuugcaaaggcgacaauaaauuauugacgcuuaaccuuuccaguuuauaagacuggaauauaauuucaaaccacacauuaguacuuauguugcacaaugagaaaagaaauuaguuucaaauuuaccucagcguuuguguaucgggcaaaaaucguuuugcccgauuccguauugguauacuuuugcuucaguugcauaucuuaaaacuaaauguaauuuauuaacuaaucaagaaaaacaucuuuggcugagcucgguggcucaugccuguaaucccaacacuuugagaagcugaggugggaggagugcuugaggccaggaguucaagaccagccugggcaacauagggagacccccaucuuuacaaagaaaaaaaaaaggggaaaagaaaaucuuuuaaaucuuuggauuugaucacuacaaguauuauuuuacaagugaaauaaacauaccauuuucuuuuagauugugucauuaaauggaaugaggucucuuaguacaguuauuuugaugcagauaauuccuuuuaguuuagcuacuauuuuaggggauuuuuuuuagagguaacucacuaugaaauaguucuccuuaaugcaaauauguugguucugcuauaguuccauccuguucaaaagucaggaugaauaugaagagugguguuuccuuuugagcaauucuucauccuuaagucagcaugauuauaagaaaaauagaacccucaguguaacucuaauuccuuuuuacuauuccagugugaucucugaaauuaaauuacuucaacuaaaaauucaaauacuuuaaaucagaagauuucauaguuaauuuauuuuuuuuuucaacaaaauggucauccaaacucaaacuugagaaaauaucuugcuuucaaauuggcacugauu

SEQ ID NO: 191583 - RNA, 66006 nt, Homo sapiens
agcgggcgggagcgcgcgcugggcccgccuuggccgccgccgcugugcugccgcugccggggaauaaucugggcggcagcgggcggccucggcuagcggccacgagccacuucugcggcugcccagagaagcaaaggucaccagucccaagucgucccccucuccgccccccaggaggggcgagagggagccgcagcugaugucagguauggccggcggaggcgcccucaggcuacggguccaaggucucgucuccccucgcccuccccccucuccggguugguggggaagcguggaggauggaaccaaaccccgggcgcggcggaacaggugucucggggucaaagccgggcuggggucguccgggcuccugaggaaggcgcgaggacuucccgcucccggagccuuagcgaucugccacagcguucggcugcguacccggccucaauuuuguggacauguacccuccucuucgucguggguccuucccuugugcccgcucgcgccccucuucugcucgcgcgcugccuggcggcgcggcggggcgcgcagugcgcccggaccggaccacuuagcgguccugccccgccgggcccucccagucccuccucccgggcccuccccgccccgccgcagaccugugggucccgccggacugggcgcccagguguugggcaccuucgccggggagccacucggcugccgcgccgccugagcgcccagcgagcgggcuccuuccagaggugccuggagcuugcuugggucuagcuuggaucaucagguuugucuguagcugauuuauuucuuuaaguuucccugccgcagagugaagcagauacguguguguuggggcauucggggcauggaggaggaagaaaggcauuaaauuuuuuuuuuuugcuucugcaccccauuuuuccccaacaaauugugauggaauuaguagguguugacaaguuguccauuugcuuugaauuuggguaagucguacacucuuaaaagaugaccauaauuuagcgcuguggauuuauucuuuccugguccuuaccgucuccccaccccccaccaccccgcauuuaaagcaaacaacaguaucagcaacaaaaaacccacacauccuggaaaaauucucaagauuucuaaccuaguucucuauauccauuguacauacuacuguauuuccuuuuaacgcuuuuuuaagauagaaaacuauugugcuaaccauggauugauuucauuaugaauuuaaaaguuauaaauuuagaaccauaaugaaucaaugaauaauuggccgauguguaagggagagaaauauguuaacuuacuaaaaguugggcauagaacauagcucugccaggaaaaagugcgcauaauuucaaguugcuucauucuggugugaguuugggaaguuggaauccgaguuuuuagaagguauuuagaugacagcuuuucacccucuuagguaaauggcaguugagcuuaaugcccaugaugcuguauguucuaaauauuguauauaguacacuauacuuucuaccagucuuuauauauagauguacaguuuaagugaauauaaaguuucaaguuagcaaacaguuaacucuucaccuuaugguaagugaaacaaugacuuaguaaggaaaguaugacucauuuaaaauucuucauaaagagaauaauuuuucaguauuaguggagagcuacuaaaugccucucaaauuugccuggaauguguauuuuuuuguaucuuccuacuuaggauuaagcauuuuagaaauauuuuguguuuccuauuuaaaguuuuucauaauuaugcuuuuuaagacuagacuacguugaguaaauucaauauccaguuauucuuaaaauuguaucacaaauuuauuucaggguacacauaaugaguucuuguuuaccuaauagaaauaugaaaaaguaugucacuaggcacaugcuacuauuuguguauugauuugugcuaaaauuaaaauugcauuaugcaguuuaacauuauaagccaugguaauuuagagucuuugugugguaaaaucauugauuggaauuuuugugacagugcagcuauaaauaaaccuuaaguagaaaauggaaagcuugaugcugaaauuaaauucagauaggcuuaaaaguuuaagcuucccaauacaaccaucuuuucuuuuagaagauuucuuaagauuugauuaaagacgcugauguacaaacuauagcaaggcugaaagaaagguaugacaaaaaucuuuuuacuucaaauucagugggauuaagucauucuuuuaaaagaagaaagguggggagcgggaaggagacuuguuccauaaaaugagaaguuagccuuuuaucuuaaaaucugguuagagaggaacuccaauguguacuuaaauuauuuugcagcuaauucaaauguccaaggggaauauauaugccaaaaucuguaauaugugagaauaggaagagggagaaaaaaaauauauaaagaaacugguguuugugauuuagggaagcacauaagaaggugggggaaacugaaaggaaagucuaaauaaauuaucuagcaccuguaguaugugcugccuugcacauugaaggggcguguugggggcaacgagaggcaauauuagggagauucuggaaugggaaaccuguauauuaaagcacauuuaaacggcuagauguuggauaauaggcagaauuugaaauuaaauacagcuuggcauaguuauuugcauucuuggucauuguauuuucuagggcugcgguaacaaaauacgacaaacugggugauuuaaaacaacagauuuauugucucaguucuggaggcaagaugucugaaaucaagauguagguauggccaugcucucucaagguucgaggggagaaucuguuccaugccucuuagcuuguuguguuacugccaauccuuagcauuuuuuggcuugcagcuaugucacuccagucugugacucuguuaucacaacauaaucccuguguggcucugucuucagauggugugcuccacuucuugcaaggauacuagucguauuggauuaagauccacccuaaucaccucaucuuaacuugauuacaucugcaaagacccuauuuugaaauaaggucacgugcagagguacuggaauuaggacuucaaccuaucuuuuguggggacacaguuuaaccuguaacaguugcacgguuuaucuuuuacaucguucaguaaauguuuagcauuauagacugaaucagaggcuauaguggaaacaggaugggacacuuacauuuauuuacauauaucagugaugucuuaaucuguuuucuguugccucuagcagaauaucugaaacuggauaaucuauaaagaaaagaaauuuauuccuuacaguuaggaaggcugaaaaguccugguucagggggccacaucuggugagggcauuugcugguagggacucugcagaguccugaggauagcacagggcaccacauggugagggggccgagcaugcuagcccagaacucuuucuuucuuucuuucuuucuuguaaagcuaccaguuccuuucccaugauaacccauucaugagggcugaacccuuaguacccagucaccauuuaaagacuccagcucucaauacugccacaguggugauuaagguucaacaugaguuuuggaggagacaaacauucagaccacagcaagugcuuacuaugugccagguccuggagauaaaacaguggauaggcaaaaaucucuguccucauggagcuuacauucugaaacacggguucuaaaaauguggucccuggaucugcagcaucaucaucaccugggaaguuguuagaaauugaaauuuucaggcuccaucccagaacucuuuauuuaacuagccuuccaaaugauucugauggagacucagguuucagaaccacugaucaagauggaaaagagacaguaaacaagaugaauaaguaaaauaauauuugauauuaauaggugcuguggguaagcauaggguggccagugaagacuccugaaaaguaaagaccugaaggaguuggagagugagccauaugagcaccugggugcguguucuuagcagagaacaguuaagugugaagacccuggcacguuugaggaaugacaagcaguuaguauuagguucaaucuaugaaauugcugcuguuuguucauuuuugaccuacaaaaacaccaaauacuggggagaagagaucagaaagaaagggguggaguaggaugcagauuguggguagauccuuguaagguuuuggcucucuaagauuaggaagacgggaggguuuugagcaaaugagugaugugaucugauuucaguuuuaaaaggaucauuguggcuauugguaaaaaugggccaaagaagcaaaggcuaaaggaaggggaaaguugguuagaauguuguuggaguaguuaaaagacagagagguugcucagaccagggugauagcaguggagaagucagaagagguacaagacuaaaaacgcacaguaaaugguuugaaaaguaaguuuuuuucaucccacuccaguuacccaguuguccuccucaaaggcaauuaguguuaaaaguagucuuaucucuauucuuccugagauuuuuuuuuuuuugagacggagucucacucugucgcccaggcuggagugcaguggcgcgaucucagcucacugcaagcucugccuccuggguucacgccauucuccugccucagccuccccaguagcugggacuacaggcaccugccaccaugcccagcuaauuucuuuuuuuuuuuguauuuuuaguagagacaggggagaucuuuuauguaaaugugagaaacaguuuuaacaaauuaguggagagguuguuaccuggaaacauuuagcaaugucuacagacauuuuuguuugucacaacuagggggaauacuacuggcaucuagugaguaaaggccagggaugcuggcuaaauauccuacagaggaccggacggcuuccacaacagagaguuauccagcucuuaaugucaguagcgccaagguuaagaaaccuuaguuuaaugggauuuacagagguuggugggaagcaaguguuguagucagagaagacaguaggaagaggagcugaccauauugggaaccuuucaguaacuguagacaguucaggauugcugaagcagacauaaauuauaaggcacagaauagcaaaagacgaggcuggaaaccuggacaggcucuaggucauagccuuuauuuauauaucauguuaauaaaaaauguuuaguuuuugucuuguaggcaguggaguuccgugaaaggauucauggggugacauggucagcuuuucauuuuagagagcucauucuggugacgggguaugaguuaaagagggauagcacuugagucagagagguuagauauuguaauagccuguggggagagaggagagucugaaauaggauaaauacuagaaauggagaggagacaauggauuagaauaauauuuaggaaguaauguuggcaagacuugguaauuggauuuggggugaagauaagggaagcauuaagaauaucuguguacuuuguaguuuagauaauccuguggcucugagugaaauaggaacccauuggugaauaauuuagguaauuaccaguaauuaagguaaaaugagcagaggaaaguaaugagucacuuuggagguguugaauuagagaugccuaugguccagguggaaguauuuagcaggcauuuguguaugugaaucugaaacuuggagaagucugaaaggaucaagagaucauuuuguuugacaaguguggagaaauuaguggacuuuaauuuuuaucauauuauuucacucuguagauaaaaauugccucccuuuauuuaauuuuuaucagaaaaguaauguguguacccgaugcaaaauuaaaacaucaaaagguuauaaaauaaaaaaaaauuuguccuuccuugcucaugccacccagugcuaguucccagagauagcucuuguuaaauaucauauguauauauaucuuaacagauuuuaaaauauauacagaaacauuuaaaaagccaagugaaaucauacuagaaaauauuucgguacauugucuuaaaaaauaaaccuuuuaucuuauacaguuguuaaaaugaaugacauuguguuauggauaaaauaagugaagggguaaauuaaagugcagacuaaccgauaagcaugaucucugauguaaauuaaaagcugaacauacauaugugaugauauaggcauuacccaacgauacgaaagcaguuacuuuuggggagagauagugguagagaugguaaagaaaauuuacucuuuucugucuaugauuuucuuucauuuguuuagguuuguuccuuuuguuuucuuuacauuuucugauguuuaaaaaaauacccaguauaccuuauuaacaauaaaaaguaaccuuugucaaaagcacaaagauuuucccuaucagcacauguagaucauuguuuuuaacagcuacuacuauucuaugcuauggcucuaucuuuuuuuuaaaaaacugguuccucaucaacagacagacgucuuaugguuauggcugucgagcaucuuggcugacuucuaugauuauaucuguaaaauaaguuucugaucaugaagugauauaucaaggcauaauuaguuaaaaauuuaaaaagauguugugaaaugcccuuccaaaagacaguaaaaguauguauuaugagaaagaauacaggacuaccaguuuucuuguaucugugucaauaacagcuguuaauaaacuuuaaaaguuuugccaauauguuagguuaaaaauaauaucucuucauuugauuuaccuuugugagugaaauuugaacaucguugaccauuuuuuacugugaaucuuuuauuuucuuuaucuguuuuuguauuugguuaacuaucuuuuuuauuauuuaugauacuuuuugguucuuuuugcuguacauuaaaaaaauauauuucauaaagaaauaugcccuuuaaccagcgacuucauugccagaaguuuauccaaugaauaaacucauaguguuuuaauagucacagcuucugagugugggagagaucucaauucguaauaucaaaaugcaaaaauauauuuucuuccaguuuuguuuuaauuccauuuucuaaaauacugaaaucuuagaaacauuugaaauuguuacuagaaaguaaggauccagcugguuuuguuuuuuuuuccccaaaagauuaauuaauucaauaccauuucuucaauaagccaccuuuuucuugauuugaaaugcuguuuauuauguauuaaauuuccacaugaauuuuuguuuuccauagagucuuuauuucaaccugaugaagucccuuuauaagauucaucugguagagaccaccagggacacaucuguaggcugacaaagguuaauuagcuugcugcagugaaggagacuugcacagcagaggaaaugucagcauuucuaaagaaggaaccaggguuauuauaggauuuuggagaaugguggaguuuggauaaaguuuaaacgcaacaauauuugauaagcuuaaagcacggcaagacugugugucaaggguuaauaaacaucaggccugggcugagaagcugacucaggauucugauucccuggagacuacaaaaucgcgauacauguggaauguugugucuggaaaccccuuaucugaagcucugaguugcaaagugagguugcuucuguuucauaaugaucuaccaucagugcgagagugggauguuccauucucacuuuauaaaauuucaaauaacauaguuucugacagucugauguagagaacaguuucucagcacauugucuuuaguauuaacaaaugcauuuuuuuaaacagacugagaguuuguucagcauaaauaccaaauuguuuucauuaccuuuuuuaagguaauauauuuuuauauguaguaaacuuugucucuuccccuuccccaguuccccuuucaagaguuuuccagugauacucaccuauuuuuccagauaacauuuagaauaauuuuugccacauuaauuuuuuaaaaucuuuuuuauaacuuaaaauugaucagaucagauuaguacaccccuucccacaaugccccuuuccagaauuucccaguuacacccacauguuuauugguccaaaguuuuagaauacuuuuugccaaguuauauaauuuuuuaaaaucuuccuguguuuuagcugggauuacuuuacauacagguuaauucggaggaaaucaacaucauuaucauugauaccuuuuuuuuuccaaacuuuuuaaaauuuugguaaaauacauacaaaguuuaccaucauaaucauuuuuaaguuuauagaucagugguauuaacuacauuuauauuguugugcaaccaucaccgcuguuuaucuccagaacucuuuauuuuguaaaacugaagcucuauauccguuuaaacgauagcucuccauucucaccuuuccacaggcccuggaaaccaaaagccuacucugucucugauuuuucacuacuuuaaaguacuucauguagguggaauugugcauuauuuguccuuuugugauuggcuuauuucauuuagcaaaauguccucaagauucauucauuuuguagcauauaucagaauuuccuuacuuuucaaggcugaauacuauuccauuguauguaaauacauuuugcuuguucauucauccucagugaacacgugguuugcuucacauuuuagcucuugugaauacugcugcaaugaccaugaguguacaaauacuuucuugaaacccugcucucauuggguauauauccagaaguggaauugcuggaucauaugguaauucuauuuuuaauuuuuugaggaauuuucauacuguuuuccauagcagaaauaacauuuuacuuucauaccaauaguauacaaggguuccaguuucuccacauucucuucaacacuuaacaauuuucugaauuuugaugguaaccauuguuauggguauaagguagcaucucauuguagucuugauuuguuuugcuaaugauuagagauguugaguaucuuuucaucuguuuauuggccauuuguguaucuuaggagaaauguguauuugagucuuuugcacauuguugaaucagguugauuuuuuuuguuugaguuuuaggaauuuucuauauauuuuggauacuaaucucuuaucagauaauacgauuugccuguauuuucacccauucuguggcuugccuuuuacuguugauagggucuucuggugcacaaauuuaaaaauuuuucaucaaaucuaauuugccaauauuuucuuucagugacucugccuuuguugucacauccaagaaaucauugccaaauauaaugucaugaagcucuuuuguucaauguucuaagaauuuuauaguuuuaggucuuauauuuaggucuuugauccauuuugaguuacuuuuucuucuuuuuuuuuuauuucaauaggcuuuuggggaacaggugguguuggguuacauggauauguuuuuugguaaugauuuuugagauuugggugcaccccucacccaagcaguguacacaguacccaauguguagucauuuaucccucacccccucccacccuuuacuucaaguucccaaaguccauuguaucauucuaugccuuugcauccucauagcuuaguucccauuuaugagugacaacuuacaauguuugguuuuccauuccugaguuacuuuacuuagaauaauggucuccaccuccauccagguugcugugaaugccauuauuucauuauuuuuuauggcugaguaguauuccgugguguguguguguguauauuauacauaccacauuuucuuuauccacuuguugauugaugggcauuuggguugauuccauauuuuugcaguuacaaauuguguugcuauaaauguguguucaaguguguuuuucguauaaugacuucuuuuucucuggguagauacccaguagugggauugcugggucaaauguuagaucuacuuuugguuccuuaaggaaucuccacaccauuuuccauagugguuauacuaguuuacauucccagcagcaguguaaaaguuuucccuuuuuaccacauugaugccaacaucuauuauuuuuugauuuuuugauuauggccauucuugcaggaguaaggugguauugcauugugguuuugauuugcauuucccugauaauuaguuguguugaacauguuuucauauguuuguugaacacuuguauaucuucuuuugggaauugucuauucauguccuuagcccacuuuuugaugggauuguuuguuuuuuuucuugcugauuuguuugguuuuuuuguagauucuggauauuagaccuuugucagaugcauaguuuaccaagauuuucuccacucuguggguugucuguuuacugauuauuuccuuugcugugcagaaucuuuuuaguuuaauuaagucccaucuauuugucuuuguuuuuguugaauuuguuuuuggguucauggucaggaagucuuugccuaagccaaugucuagaaggguuuuucugaugauaucuucugggacuuuuaugguuucaggucuuaaaagauuuaagucuuugaucuaaucuugaguucauuuuuguguaaggugagagaugaggauccaguuucauucuucuacauguggcuugccaguuaccccaguaccaucuguugaauaggguguccuuuccccacuuuacguuuguguuugcuuugucaaagaucaguuggcuguuaaguauuuggcuuuauuucuggguucuguauucuguuucauuggucuaugugccuauuuuuauaccaguaccaugcuguuucgguaacuauagccuuuuaguuuaguuugaagucggguaaugugauacauccagauuuguggguuuugggggguuguuuuuguuuuugcugagucuugauuuggcuauguguguuccuuuucaguuucauaugaauuuuaggauuguucucccuagcucugcaaagaaugauggugacauuuugauaggaauuacauugaauccguagauugcuuuuggcaguaugaucauuuucacaauauugauucuacccauccaugagcauggaauguguuuccauuuguuugugucauuuucaauuucuuucagcaguguuuuguaguuuuucuuguagaugucuuucacuuccuuagguauauuccuaaguauuuuauuuuuuuuuugcagacauaguaaaagaguuugaguucuugauuugauuugcagcuugguugcuguuaguguauagcaaugccaccgauuuguguacauuaauuuuguguccugaaacuuuacugaauucauuugccaguucuaggagcuuuuuggaugaaucuuuaggguuuucuugguguaugaucauaucaucagcaaacagcaacaguucgacuuccucuuuacugauuugaugcccuuuauuuccuugucuugucugaucccucuggcuaggacuuccaguacuauguugaauagaaguagugagacugggcaucccugucuuguuccagaucucaggggaaaugcuuucaaccuuucuccauucaguauaauguuagcuguagguuugucauagauggcuuuuauuaccuuaaggcaucuccuuucuaugccaauuuugcugaguguuuuaauuauaaagggacacuggauuuugccaaaugccuuuucugugucuauugagaugauuaugugauuuuuguuuuuaauuguuuaugugguacaucacaauuauugacuuggguauguuaaaccaucccugcacgccuggcaugaaacccacuugauaaugguguguuaucuuucugauaugcuguuggauucggcuagcuaguauuuuguugaggauuuuugcaucuauguucaucagggauauuggccuguaguuuucuuuuuuuuuguuauauuauuuacugguuuuaguauuagggugauacuggcuucauagaaugaauuagggaggguuuccucuuucucuguauugugggauagugucaauaggauugguaucaguucuucuuugaauauuggauagaauuuagcugugaauccaucugauucuggacuuuuuguuuguuggcaguuuuaauuaccauuucagucuugcugcuugcuguuggucuguucagaguuucuauuucuuccugguuuaaucuaggaggguuguauguuuucaggaauucacccaucuccucucgauuuucuaguuugugagcauaaagggguucauaguagccuugaaugaucuuuuguauuucugugguaucaaucuaauaucuccauuucauuucuaauugagcuuauuuggaucuucuuugcuugguuaaucuaacuaaugaucugucaauuuuguuuaucuuuucaaagaaccagcuuucuguuucauuuaucuuuuguguuuuuuguuuguuucuuucuuugucucaauuucauuuaguucuguucugaucuuuguuguuucuucuucuggauuuggguuugguuuguucuuguuucucugguuccuuaagguguaaccuuagauugucuguuuaugcucuuucagacuuuuugauguaggcauucauugcugugaacuuugcguuuagcaccacuuuugcuuuaucccagagguuuugauagguugugucacuuuuaucauucaguucaaaggauuuuuaaauuuccaccuugauuucauuguugacugaaugaucauucaggaguagguuauuuaauuuccauguauuuacaugguuuugaggguuccuuuuggaguugauuuccaauuuuauuccacuauagugugagagaguacuugcuauaauuuugauuuucuuaaauuuguugagacuuguuuuguguccugucguggucuguuuuggagaaggauccaugugcugaugaauagaauguauauucuguaguuguugguaaauguucuguaaaugucuguuaagucaauuuguucugggguauaguuuaagugcauuguaucucuauugauuuucuguccugaugacuugucuagugccgucaguggaguauuaaagucccccacuauuacuguguugcuguuuaucuuauuucuaaagucuagcaguaauuguuuuauaaauuagggaacuccaauguuaggugcauauauauuuaggauugugauauuuuccuguuggacaaggccuuuugucaugauauaaugucucucuuugucuuuuuuaacuuguugcuuucaagucuguuucgucugaaacaaaaauagcuacuucugcuagcuuucuguguccacuggcuuggaauaucuuuuguuguuguuguuguuguuguuguuuuuguaauuuaauuuuauuuuuuauuauacuucaaaguucuaggguacaugugcacaacgugcacguuuguuacauauguauacaugugucauguuggugugcugcaccuguuaacucaucauuuacauuagguauaucuccuaaugcuaucccuccccccucccccaaccccaugacaggccccagugugugauguuccccacccuguguccacguguucucauuguuuaauucccaccuaugagugagaacauacgguguuugguuuucuguccuugcgaugguuugcucagaaugaugguuuccagcuucuuccaugucccuacagaggacaugaacucauccuguuuuauggcuauauaguauuccaugguguguauguaccacauuuucuuacuccagucuaucauugauggacauuuggguugguuccaagucuuugcuauagugaauagugccacaguaaacauacaugugcaugugucuuuauagcagcaugauuuguaauccuuuggguauaugcccaguaaugggauggcugggacaaaugguauuucuaguucuagauccuugaggaauugccacacugucuuccacaaugguugaacuaguuuacaaucccaccaacaguguaaaagcguuccuguuucuccacauccucuccagcaccuguuguuucuugacuuuuuaaugaucgccauucuaacuggugugaaaugguaucuuauugugguuuugauuugcauuucucugauggccagugaugaugagcauuuuuucauguguuuuuuggcugcauaaaugucuucuuuugagaaguaccuguucauauccuuuucccacuuuuugaugggguuguuugauuuuuucuuguauauuuggauauuagcccuuuaucagauggguagauuguaaaaauuuucucccauuguguagguugcccguucacucugaugguaguuucuuuugcugugcagaagcuuuuuaguuuaauuagaucccauuugucuauuuuggcuucugugccauugcuuuugguguuuuagucaugaaguccuugcccaugccuauggccugaaugguauugccuagguuuucuuacaggguuuuucugguuuuaggucuaacauuuaagucuuuaaugcaucuugaauuaauuuuuguaucagcuauaaggaagggauccaguuucagcuuucuacauauggcuagccaguuuucccagcaccauuuauuaaauagggaauccuuuccccauugcuuguuuuugucggguuugucaaagaucagaagguuguacaugugugguuuuauuaccgagggcuauauucuguuccauuggucuguaucucuguuuuuguaccaguaccaugcuguuuugguuacuguagccuuguaguauaguuugaagucagguagcaugaugccuccagcuuuguuuuuuuggcuuaggauugucuuggcaaugcgggcucuuuuuugguuccauaugaacuuuaaaguagcuuuuuccaauucugugaagaaagucauugguagcuugauggggauggcauugaaucuauaaauuaccuugggcaguauggccauuuucaugauauugauucuuccuauccaugagcauggaauguucuuccauuuguuuguguccucuuuuauuuuguugagcagugguuuguaguucuccuugaagagguccuucacaucccuuguaaguuggauuccuauguauuuuauucucuuugaagcagucgugaaugggaguucacucaugauuuggcucucugucuguuauugguguauaggaaugcuugugauuuuugcacauugauuuuguauccugagacuuugcugaaguugcuuaucagcuugagauauugggcugagacgaugggguuuucuaaauacacaaucaugucauuugcaaacagggacaauuugacuuccucuuuuccuaauugaauacucuuuguuucuuucucuugccugauugcccuggccagaacuuccaacacuauguugaauaggagggugagggagggcaucccugucuugugccaguuuucaaagggaaugcuuccaguuuuugcccauugaguaugauauuggcuguggguuugucauaaauagcuuauuauuuuaagauaugucccaucaauaccuaauuuauugagaguuuuuagcaugaagggcuguugaauuuugucgaaggccuuuucugcaucuauugagauaaucaugugguuuuugucuuugguucuguuuauaugauggauuacguuuauugauuugcguauguugaaccagccuugcaucccagggaugaagccaacuugauugugguggauaagcuuuuugaugugcugcuggauucaguuuggcaguauuuuauugaggauuuucacauccauauucaucagggauauuggucuaaaauucucuuuuuuuuauugugucucugcuaggcuuugguaucaggaugaugcuggccucauaaaaugaguuagggaggauucccucuuuuucuguugauugggauaguuucagaaggaaugguaccagcuccucuuuguaccucugguagaauucggcugugaauccaucugguccuggacuuuuuuugguucauaggcuauuaauuauugccucaauuucagaaccuguuauuggucuguucagggauccaccuucuuccugcuuuagucuugggaggguguauguguccaggaauuuauccauuucuucuagauuuucuaguuuauuugcaucaagguguuuauaguauucucugaugguaguuuguauuucugugggaucgguggugauaugcccuuuaucauuuuuuauugcaucuauuugauucuucucucuuuucuucucuauuagucuugcuagcggucuauccauuuuguugaucuuuucaaaaaaccagcuccuggauucacugauuuuuuuugaaggguuuuuugugucucuaucuccuucaguucugcucugaccuuaguuacuucuugccuucugcuagcuucugaauguguuugcucuugcuucucuggaucuuuuaauugugaugucagggugucaauuuuagaucuuuccugcuuucucuuguggucauuuagugcuauaaauuucccucuacacacugcuuuaaaugugucccagagauucugguauguugugucuuuguucucauugguuucaaagaacaucuuuuauuucugccuucauuuuguuauguaccugauagucauucaggggcagguuguucaguuuccauguaggugagcgguuuugagugaguuucuuaauccugaguucuaguuugaucgcacuguggucugagagacaguuuguuauaauuucuguucuuuuacauuugcugaggagugcuuuacuuccaacuaugugguaaguuuuggaauaagugugauguggugcugagaagaauguauauucuguugauuugggauggagaguucuguagaugucuauuaggucugcuuggugcagagcugaguucaauuccuggauauccuuguuacaacuuucugucucguugaucugucuaauguugacaguggaguguuaaagucucccauuauuauugugugggagucgaagucucuuuguuggucucuaaggacuugcuuugugaaucugggugcucuuguauuggaugcauauauauuuagaauaguuagcucuuuuuguugaauugaucccuguaccauuauguaauggccuucuuugucucuuuugaucuuuguugguuuaaagucuguuuuaucagagacuaggauugcagcccuugcuuuuuuuuguuuuccauuugcuuguuagaucuuccuccaucccuuuauuuugagccuaugugugucucugcacgugagaugggucuccugaauacagcacacugaugggucuugacucuuuauccaguuugccaguuugugucuuuuaauuggagcauuuagcccauuuacauuuaaaguuaauacuguuagguguguauuugauccugucauuaugauguuagcugguuauuuugcucguuaguugaugcaguuucuuccuagcagcgauggucuuuacaauuugucauguuuuugcaguggcugguacggguuguuccuuuccauguuuagugcugccuucaggagcucuuguaaggcaggccugguggugacaaaaucucucagcauuugcuuguguguaaaggauuuuauuucuccuucacuuaugaagcuuaguuuggcuggauaugaaauucuggguuagaaauucuuuucuuuaagaauguuguauauuggcuuucacucucuucuggcuuguagaguuucugcagagagaucugcuguuagucugauuggcuucccuuugugaguaaccugaccuuucagucugacaauuaugugucuugggguugcucuucucgaagaguaucuuuguggcauucucuguauuaccagaauuugaauguuggccugccucgcuagauuggggggguucuccuggauuauauccugaagaguguuuuccagcuugguuccauucucccugucacuuucagguacaccaauaagacguagauuuggucuuuucacauggucccauauuucuuggaggcuuuguucguuucuuuuuacucuucuuucucuaaacuucucuucucucuucauuucauucauuugaucuucaaucacugauacucuuucuuccaccugaucaauucggcuacugaagcuugugcaugcaucacguaguucuugugccaugguuuucagcuccaucaagucauuuaaggacuucccuacgcuguuuauucuaggcagccauucaucuaaucuuuuuucaagguuuuuagcuucuuugcgauggguucgagcauccuccuuuagcucggagaauuuguuauuaccgauugucugaagccuucuucucucaacucgucaaagucauucuccguccagcuuuguucuguugcuggcgaggagcugcguuccuuuggaggagaagaggcgcucugauuuuuagauuuuucagcuuuucugcucugguuucuccccaucuuugugguuuuaucuaccuuuggucuuugaugauggugacguacaaaaugggauuuugguguggauguccuuucuguuuguugguuuuccuucuaacagucaggacccucagccgcaggucuguuggaguuugcuggagguccacuccagaccguguuagccugguuaucaccagcggaggcugcagaacagcgaauguugcagaacagagauguugcuacccgaucuuuccucuggaagcuucgucucagaggggcacccagcuguaugaggugccagucggccccuacugggaggugucucccaguuaggcuacugggaggucagggccccacuugaggaggcagucugucuguucucagaucucaaacucugugcugggaaaaccacugcucucaugaaagcugucagaccuggauguuuaagucugcagaaguuacugcugccuuuugaucauacuggugaccagggaagcgggggaaagccggcaguaacaggccucacccagcucccacaaagcccgaaaggccagugccacucccaaggugccucuuccagcagcacugaguuaauuuccaggcagcugcugagcaguauugagaagcugccccaggcuauaugcccucccccucccccgaggaaguaagcagggcuuucagguuucacgcuucccuaccugccgugguuucuuugcugcuuucugcacugccuguuugccuccucccccgauucuguccaggaaacuucauguuuguuugaaacuguuacacaguucagcuggaaguuuccuucuccuuggggucuuuccccaauuccacuggcagcucuccccaagggccucugugagacaaagucaggaauggcuucccuggugacagagagugcccacagggcucuucugcuucuuccuuuaucccuauauuucucacagcucucuaaauuaaucucagcuccaggugaggucacauccuucucucgugaauuggcccuuugggauccccagugaggauguguguucagaggcagacauucccuuucacacauugggcacucagaguuuuuuggcugucucaggggaccagcagcuguaaacugcuuccuuugaaaggucuauggauucucucggcuuuccugguacguucccgugguaguaguucuucgaguaaaaguucacggugugagucuccacacacuacucggugugucugagugggagcuccaaguuaguuaugcgcccugucugccauuauuuucccauuuugaguuaguuuucauauauuguguuauguaaaaguccaacuucauucuuuugcauguggauauccaguuuucccagcaacauuuguuaaaaaccuguccuuuucccauugaauggucuuggcucccuucccaaaaauccuuugaccauaaagugagaugcuuuuuuuccucugaauucuuuauuucauuguucuguaugucuguuuucaugccaguacugcacuauuuuuauuaacguagcuuuguaguaagucuugaaaucaguaaguaugaguuuucuagcuuuguaccucuuuuucaaaacuguuuuggcuauucagggucccuuaauauuccauaugaauuuuagaauggauuuuucucuuucugcagaaagcauuguugggauuucaguaggaacugcauugaaucuguaggucacuuuggauaguauugacaucuuaacaauauuaaguuuucuaauugaugaacauguaaugucuuucuaauuauuuauguauucuuuaauuucuuaaagcaguguuuuguaguuuuugucguacagaucuuucacugucuugguuaauuccuaagguuucuuuuuuuugcuguuguaaauggaauuauuacuucaagaaguguucuaguuagugcguaaaaauguaacucauuuuuguguugacuuuguauuugcuucuuugcuaaauuaauuuauuaguucuaacagguuuuuuuuuuuuuuuggaaucuuuaggguucccugcauauaagaucauaucauuuguaagaagauaauuuuacuuuuucuuuccaguuugguugucuuuuguuucuuuuucuuuccuaauugcucuggguagaacuuccaguacuauguugaauagaagugaugaaaucaggaauucuugccuuguuguagaucuuagaggaaaagcuuugaguccuuuaccauuugaucuuaaaggaaaagcuuuuaguccuuuaccaugugucugauguucacuguggguuucucgugaguguuuauaucaugaaagcauauugaauuuugucagauacuuuuucugcaucaauugagaggaccauguaggguuuuuuuuuccuccuuaauucuguuaaugagguguauugccuugauugauuuccauauguacaacuauccuugcauuccaggauaaaucccacuuggucaugauguauauaaucuuuuaauaugcugcugaauucaguuugcuaguauuuuguugagaauuuuuacaucacuguuaauaauggauauugguuuguaguuuuuuuuuucucuuuuuagguugcucucauuucuauuucuaaaaauaauuuuaauugacacagucauuguacauauuuauggaguacauagugauguuacaguacauauaauguaucaggguaauuagcauauccaugaucucaaacacuucuuuguguugggaacauucaguauccuccuccuagcuguuugaaacuauauuauuauuguuaauuauagucauccuacaguacuauagaauacaauaacuuauuucuccaacuauuaucauuagcuguaauuuugcauccuuuaacacaucucucccuaugccucccuuccccuucuugguuucuacuauccuuuguugguuugugguuuucuugugugucuuugucuggcuuugguaucaggguaaugcuggccucacagaauaagucaggaaguguucccuccucuucuguuuuuuuuuuuuuguuuuuuuguuuuuuuuuuuggaaaaguuugagaaggcuugguuuuaguucuuuuucacauguugagcagaauucaccagugaagccaucauguccagggcuuuucuuuguugggagguuuuugauuacucauucaaucuccauacugauauaggauuuucagauuuucuguuuguuauucuguuucaguaaguuuuguguuucucacaguuuuuccucaucuagguuaugcaguuguugacauucgguuguuuauaguauccucuuaucauccuuuguauuucugugaaacuauuagcaaugcccuacuuucauuucugauuucaguaauuugagucuuuucuuuuuuucuuagucuagcuagagauuuaucaguuuuguuccuuuuugaagaaccaacuuuuaguuucauugauuuuuccauguugcuuuccuguuucccauuuuguuuaucucuguucuuuauuguuuuauuucuucugcuagcuuuggguuuaguuuguucuuuuucugguuuuuaaaguuguaaaaauagguucuugaauugagaacuuucuuuuuguuucguguguuaauaacuauaaaugucuuccuuagcacugcuuuaucugugucccauaaauuuucuuauguuguguuuuucguuugucucuaaguauuuucuaauuacucuugugauugauucuucgccccauugguuguuugauuuccacgcauuugugaauuuuccauuuuccuucuuuuauugauuucuaacuucauuguauugugcucagagaagauacuuuguaugcuaucugucuuuuaaaaucuauuaacacuuuauuuguggccuaacaugguguauccugggaaauauccccuguguacuugagaacaauauguauuugguuauuguuaggcagaauguucagucuaugucuguuagaccaaguugguuuauuguguuguucaaguucuccauucugugugguucuguuaauuauugagagugggguacugaagucucccaacuguuaucauagaacuauuucuccuuucauuuuuuucaccuuugguucguucaucucaguggucuguuauuagguauguaaguguuuauauagcugaccccugaacaacacagagguuagggaugcuaucccccccacggaaaucugcauguaacuuuugacuuuucuaaaguuuacuaauagacugccgcuggaagucuuacugauaauguaagcaguugauuaacacauuuuauauauguauuauuuacuguguucuuaugauaaacuacagaaaauaauguauuaagaaaauuauaaaggagagaauuuauuuacaguucauuaaguggaaguagauaaucaugaaugccuucauucuugucgucuucacauuggguugaggaaaaggaaggauuggucuugaugucuucuggguggcagagguagaagaagaugcacauauagauggaccuauacuguucagacccauguuguucaagggucaacuauaauuguuauaucuuuugcuguauugaaucuuuuauuaauauauaauguccuucuugucuuuuguaaccuuuuuugauuuaaagucaauuuugucugauauuaguauggcacuucuguucucuuuguucuuguaugaauggaauaucuuuuuuucaugccuucacuuucacccuguuugugucuuugggccuaaagugagucuuuaguagacagcauguaguuggaugauguuuaucaauucugcaaaucucugccuuuugauuagaguuuaaccauuuacauuuaaaaucauaaggaggaacuucugucauuuugccauuuuuuucuaugugcuuuguagcuauuuuguccuuauuuccugcauuacugucucauuucuuuuuguguguauucuauaagcuauuuucuuugguuacugugaugauuacacuuaauauuuaaaaauuacaauauuuauaccagcuuaauuucaguaacauaaaaaaauuaugcuucuuuacaauuccauccccaccacuuauugauguugcagaauuauaucuuuauacauugugugucaaaaaauauaaacuaauuuuuuaauguguuagucucaaguuauguaaaaaaauguggaguuccaaaguuacaauaauacuagaauuuauaauugccuauguauuuacugucacugcaauuuuuauuuuuucauauagcuacaaguuauuaucuaguauucuuuuguuucgacugggagaauuuugcucuacagagcaggucuuuugguaauaaacucucucagcuuuuuacuugagaauguuuuauuuaagaaugucuugagaggcugaggcaggcgaaucaccugaagucgggagucaagaccagccugaccaacauggagaaacccugucucugcuaaaaauacaaaaaaauuagcuggguaugguggcauacugcuguaaucccagcuacucgggaggcugaggcaggagaaucgcuugaaaccaggaggcggugguugcaguuagccacgaucgcgccauugcacuccagccugggcaacaagagcaaaacuccgucucaaaaaaaaaaaaaagaagagaaugucucagcuuuuguuuuaaaggacgguuuuuguggauguaggauucaugguuggcauuuuuuuuuuuguuuuauuaucuuaauuauauuggccuaugccuucuguccuccaaagugucugaugagaaaucugauaauuuuauugaggacugcuuaugugugauuaguuacuucuuucagcuuucaggauuuucucuuugccucuuagugguuucauuauaauauauuuugcugugagucuccuugaagucauucuacuuggagucuuuuucagcuucuuagauguuuauauucaugccuuuuauuaaaauugggauuuucaaccauuguuucuucaaacauuuuuucucucuccauuacuugggacuaugacaguguuuauguaggccuacuugauggugucacaagucccuuaggaccuucacauuucuucagccguuuuucuuuguuuuccuaagacucaauaauuucaauuguucucucuucaaguucacugauucuuuuuuucuuccugucuagaucugccuuucagucucucuaguggauuuuuaauuucauuuauuguacuuuucggcuucagaauuuuuguguguauccuuuuagguuuucauucucuguguuucucuuacucuguugcuuuuuuuuuuuuuuuuuuuuuuuuuuuuuugaggucucacucuguugcucaggcuggacucaaacuccugggcucaagcaauccucccaucccagcuuccuggguagcugggacuguaguugugcacacugugccuggcucagauuuuccaugucuuuauucauauuuccauuuuguucauacaucauuuucuuaacuugguccacauuuuccuuuaguucuuugagcauuuuucagaaaguuguuuuauagucuuuguuuaacagaucuaccaucgggucuuuuucagggacaauuuguuaguuuauuuucuuucuuuuagugggccauauuuuucuguuucuuuguauaccuugugacuuuuuuguugaaaacuggaugcuuaaauuuaauuuaaugugguaauucuggaaauuagguaguaucccuuccucagggugugcuuuuuuucuuuguuuuuuuuuuuuaauuguugcagucucuuugccaaagaucagucugagauuuuguacaauuaagguauuuucaggucuuuucugugccugugccuuaagcuggauauguaauacaauagucccucuuuaucccugcuuccacuuucugaaguuucaguuauggucaacagugguccaaaaauauuaaauggaaaacuucagaaauaaacaguucauaaguuuuaaauuacaugcuuucugaguagcaugaugaaaucuuguuucaaccugcuugggacaugaauuaucccuuuguccaucauaugcacguuguauauguuacucacccgauagucacuuagcagcugucuugauuauuagguugacucucgugguauugcagugcuuguguucaguucaauaaaguuaagguucaauaaaguuaaaauaaagguucaauaaaguuaaccuuuauuuuacguaaugacccuagggcacaagaauagugaugauggcauauugucaugauuuuuuuuauuauuuaauaucuuauugugccuaauuuacaaauuagacuuucucauagguguguauauuuaggaaaaaacauaguacguguaagguucaguacuaucugcgguuucaggcauccacugggguucugggaacauauucccuguggauaaagggggacuacuauagugaauuucuauuuucccuuguauaugcaguuucuuuugaaugccucaguccuugauguuuggcuccuaaaaaaaaaggaaaaggacaaaaaugaagaggguuggggagagcaccagccuuuaaguuccuuggcaguuaccucagcuagagggggaggggcuugcaucaguggguggagguacaaccacaauggcugccagccccugcaccuauaucuucgugaucagaaguagcagucaacagucagaacacccauuccugauauuuggaggacgggguccuuauugcccacccuaacucccacagcuacauauaagcugcuccacaaacacgugcacaguugccugccugugggagugagggugggguggggucgguagcugcugcugagcaaauaacugaaauugacugaaaucagccacaguuuaccuuacuguccaggacuuuuucuugaaguuugaaguuuucaguauacuuugagagcuucauaauaguuguaugagauagauucuaccagcguaaguguucucuggguauacagacucauucuuggugcuuucuacucuacugucauccaagaauccucuaacuuaaucauggauucuucguaucucacaacacaucuugucuuuccauuuacucguuuuauuuuagauccuuuauggaauuauaguuuucuuuauguagagccuauacauuuauaguuuuguuauucuuuguuacuuauagcuuuuuuguuugcuauugaaacgugaccuuccauuauaagucgcauauuaucugcauauaaaaagugauugacuucacauacuuuguaaauggcagccuuaagugaauuuacugguuuuuuuggacagcauuuuaguauuuuuuccgaagauggccauaguaucugcaguuaaugaugacuuucucaccucuucugaaauauuuguaccuuuaucuucuugugcaguuggauuggcuagugcuuccaguauuaaauaguguugauaaccugcacccuugucuuaaauggauacuuugugcauauaaguauagaaacaggagcaugaugcagaaagaacaagcucuucaagaauaaucugcuuccagguaugucuuacagccuucugaaccuuguaauggauaaggaucagccuacuccugggacaggcagauaggacauucguggagaaagaauauuggauguuccuagaaaguuuucagugugauaaagcaguauaauuuucucccaaccuuggguauuguagaaccuuucacucacguccgugugaagagaccaccaaacaggcuuugugugaacaauaaagcuuuuuauuucaccugggugcaggcgggcugagugcgaaaggagagucagcgaagggagaugggguggggccguuuuauaaaacggccuauuuauaaaaauaggauuuggguagguaguggaaaauuacagucaaagggaguuguucucuggcgggcaggggcgggggacacaaggugcucagugggggagcuuuugagccaggaugagccaggggaaggaauuucacaagguaaugucaucaguuaagggaggaacaggccauuuucacuucuuuugugauuuuucaguuacuucaggccaucuggauguauacgugcaggucacaggggauaugauggcuuagcuugggcucagaggccugacagaaccuguugagguugcaaaaaauauuugugacucuuggaacaguaacaaaaaguuguucugacuuuuuauuuucugaaccuggaauugugggacuauuuuaaaggguauaauuucaacuggagacuuggggagcuugauuuugacuugauugcgaagcaucuguauagcucauguuguauguccaguuuauggcuuuguauuauagaaauguauuuaaagcuucaaaugaugagaccaugcauaauuucauggugggcagauucuuuuuuuuuuuuuuuuuuuuugguuuuaaggagcggagaguuuaauaggccagacagaagggagaaggcagaaggaagaagcucccccguacagagacagagggagggaggcuccaaagccaagagaagggauccccaagugcgguggacaccagccagguauauaugcagaggcuggagaaggugguguucgauuugcauagggcuccggggauuggguugacuaggcgcaucauucacauagcucaugaaaaagcuggcucuuccacccuggucuuuuaauaugcaaauacauggcgccaugauguucuacgcucgucgggauuccaggaacauguagggcaagggcaagaaggcugugggaaucuccauguuuggguggacccaguuucuaauggccuaaauuugcauaugaaagguugcuggccuggcuuuaacagccguggcuuuacaagaaacuuuucuggagaugcuuuaaaaaaugaaaacuuuccaaggaccccuuuuucuucucugccuaaaauaauuucuuaauaacuccuacaacauucccgccuguggagaugccacacuaacugcuguuagaggguuuugggcaacaacuccuucuggcuacuuacugcugaaaaggggcaucauauggggaacagcaacuagggcuccuccugggguugaucuaaggauccucggaagaauggcauguccauguguggaucaguuugcagcaccauuuggagauugauugcuucuaggugagaguuacaguauugaguauacagggcccagauaucaauacaagacauauaaacaagagaaggcuuaaaaaaggaguuaaccaauuccuuaaggaagacuggaauguauuaaagaagaauuuguagccacccggggcugaagcuggcguuuucccugagccugucaauaauuuugauuugaucuuuaaguaccuguagauuuuucucuacuuuacuagagguguuaaucaccccuaaacccaaaaaaaguccuagcagacucagugauaguaaaacuuucaugcuuccuugucaguaacuauuauuccugcucuaaggauaauaauuaagcaaaauacaacagcaauggaaacucuguccaauauuucaguuagaaggugcuaccguguguaucccuauugcaaacaguagagugaguauagcaguucccacaagugugguguaguagauaauuuccaucuaaaauuuuacuugccaagauaauuucccuuugguggucuaugaagcuuugguuuuauuuuccuaaacaaagaaaccuucggguuauggauacccuacuuacuuuuauuaccuggcagaauuugcaggauaauuucccacaauuaguauagugauucagauuuuuacauuacccaucccuuuuucuuucuuccaagcugcagaagauuaccacuugagucacaggaauaagcaggguuaauuuaaaauguaggcaaaaagcuuaaaaacaauuaaugagacuaggauuuaaugacaaauguaugauaagcuuuggagcaaaauuuucucuccaguucucauuuuugguaaaagcuaauugugaaugaacuuuagucuuauacuuggccugauuauuugcaugaaguguuagcaagaaugguuauuucuacauaggucuuuuggauggcuuugauaaaacucaguuccacaaggaaucuuagauaagaccuuuaaagccuaggccagcaauggguuucuauccucaaauaccugugaguuaggugauccucucuucuugaggucccaagaaacucggagcuuccagaccuguuagaaagugacguucuuuacugaccacagguuaggagcccugugcggggacuguguagacaagguaugaugccaguucucccaggggcuuuuuauuggcucugcgugucaagcuugauuccuuaaagggaaacacacccuuucagucaaagccuugguauaauaaccaguuuuuccaauuguguccuguugagaaagaaaaauggauucuuacugcacuaaugcaaacaacuauauugccauaaguuaagaguaauuacaguuagucuccaaauuauagaggaaccagguggggaaaaaugaacauuguuacuuauguccguauaagagaccaccugagcaggcuuagugugaucaacaaggcuguuuauucacuuggguccaagugggcugagucagagaaaggagucauugaaggauagugggauuagcauugguuuuuaaagguuugggauaagugguggagucaggagcaauuuuuuguggguaagggauggauguugcaaaguacauucacaagggcggggaggaauguuucagaguacauucacaagggaggggaggguguauugucacaagggcugggaggaauguuacaaaguacauucacaaggacagggaauaucacaaaguacauuaucacaaaggcaggggaaugucacgauggcuugaccauggugcagccagcucagaggaccuuacaaaacaugcuccaaauuuuguuuacaguaguauaccuuacucaauuauuaaaaggucauaaauaguuuagaauaaguuuccuugacucugaaaaaccaaacaaggaucaacaauauuccaagcaaaaguuaaaaaguugcuuaaacuuuuugagugcaguccacuuaguuaacucuuguuuugcuugauauuugugagcaugucaguucuuuaggagucccauaucuucuuucucaauuucaguguuacaaucuucaaagcuauuaaaaaccugcaguuaaaguccuuaauauagcuugauuauaaaccgucuuuugagaaggaacaaagcaagacaacaauugucugcaaaugacaaaauuuucaggauagcuacaguuaaaaacaugacugauaauuuauuuccaugguuuacaguaacuuuagccuuaauugugauugacagcauguacuucggcauuagaauuuuagaaaucccauacaauuuuggaacguauauuaguauuauuuaccgaaauauaauuuaaagaagauuggacaucauuuuggcaaucuuaugugacuaaacaugucagaugauuccgucuaccuuuucucugaauguuucaggggcccucugagccauccagaaagccaggcaucaggaaggacaauuuccagauuggcauaaauauuuugccaaaauggugacuuaaaaggcaaaaaucuuucauuagccuuuacugugacaugaaaauuuuguuuaaauccaaauuuuacccuugcacuaguuuauuaauguuaaccccaauuaguuuaaaugaaaccuuauggauuauuucaucuaauuuuauccacuuugaccaugagguaaaaaucuuuacaaaccuuuuauaaccuuuuuacuaaagggcagauuagugccuuaagacccucuugcuaugcguuuauuucaaugcuuaauuuaugaaaagaacauauaaauaucaugggagaagacacuguaguucuucuaccaugcauuucauugcaaggcaacccaaagccaauuggcuuauuuuguaaucaguccaucccugaugggaggcucaucucccagugggggguagggauguuuccuuaucuuccagguggccaagagcaugcuuucuaauuuauaacuacuauuagccaucccuacaguguauuuucuacuuaguuauuacacaccaaagcuuuucauaaugugaaguaauuugauaccccccaaacuuaaaacacaguagauaacacaaugcaaaacagaauagagccuuugauuuugagagggauccaucuccuuuuaauuccugggauuucaugaggaaaaaaagguuuuuuucccaaaacagggucuguggcaucuccuguuuuucccaaggaguuccaugcuaccagaaguuaucuuaggaccucucaugcaugcauuaagagugguaagacaaaaaauggagaaaaauaauucagucgacugaggagagccuuuuuccagaaaaacaagauccaagaagagaaaaacauaaaagccuuuuaaguauaccuauaacuugaauauccacuuuuaauuaagcugagcacucuuuaaggaaauccuuuuaaauccccuguuacuugacuuuagccaugccaagcaguuaagauuuucggcuuucgaacuuucgaaaguaaccucacaggugaaaccaacaaggcuuaaucagguaaugacucaacugaggguguacagaguauuuucaaaauugagacugagacagugaaagagauccaacccaagcaacuccauuugguuuccagcccccaagcuguccuugcccaucccagggguaggccgaacaaacuuucggagaagccggguuuacauucuccagucgaaaacaaagaugauaauagccacuucccaugauauacuuuccacuugccuggggaccagaccaggaagcuagcuacaagacuagaaaccuuggcccaggagccaugcagcuggaggcuacaagauuuugacccuccuuaaacugcucucaagaucaggcuuaagauauuuuguaaacccugccucugauggaucagcugguaccauccagguugacuaacuggauuaucugauuuuguggcccucacccaggaacugacuuagcacaagaagacagccaccauuguaaaaugguggagacuaaaacaaaguauugccacgcgguuacagaucguguucccaaggacgugaaacaagauggaggcuguagccaaguuugccaccgacugcuuugcugggcuggcuugaacagcaggcuuacggaguccugggccugcauccuaaccuaagguacccuuucuuugacagaaccauacagaaagagacaugcaaagcacaccagauuguuuauaacugaagaccaaccucacaaauccuucuucauuaauuauaaauuuacagagaauauaaacaaugauccuuauuaucccuuugccaguuugugccgggagagaaaagccaaaagcccgacugguaagaaauuuuuacacuuuugccagcauaucaggcuucuggguucccuuucccccuagcuuaacuuuaagccaagcauuuuaagguuuggaaaauuagccuuuuucagguuggaagaacauuauaaaagagacagaagccauuuuaaaccgcgaaagaaggaaaaacaccauagaaaggaauuccaguuaggguuuucaagaaguauugccucucuuccuauugggaauaguguuuccucuauuucuuugccuucccuauuuuuucuuuucccuuuuggcguacuguaggagacauauugcuuaucuccaaaauucucuucugcuugcagagcugccuguuuuagcugcagugagggcuugaguuagcagcaacauaacauccucccgugugagguuaaauaccugaguuaaauuuuggaaagucucuguauaccuauuucgggucauuagaaaaucagucuaagucuccuuuuacuugccuaagguccugcaaugagcagggaacuugaaggugccccaaauaagggggaccccuagaugauuucccugaaaguuacuuuuuuuuuuaauuuuggggaacuauuuucccugggccugcccaauauggugcuaaaagaucugaguugaucuuacaacgcuugcagagguuuauuagaaaugccaugcucuucugcaaaagaaaaugaguugcuuucuuuaaaguucugagguuaaggaaguuccaguguuugagagugcacuccagaggggugcaagcugaagauaauuuauuacccauuuagaaaaagaagcgagaauaaaagcauuuucuuagucuccuuccuuucuguaugacccagaguggaggagaagacgggguauccucugaaugucuuaccuucccaguuucuggauuccggcaccuucuuaaaugugcucccccaugguuguaggcaugguccuccaagcuguggaucuggaugaacuaaguaauggggcuaaccacaucuacccaagcagccuuagcuuauccgccuugugugauuucucuuugacuuccuagaaccagugugauuugccuggauccccccucccccagccaaaaaaaacaucuggagaggcugucaccuuucgggcaaggcuccuuuaacggaggcaaugugcuauagauugccugcuauuacggcccaugcuauaaagcacuuacccuugaaagaaaacaguuccaguuaacuuccgaacuuaaacuucccuuacuaauuaaguacuaucuuaaucggagacagaauagaugccuuaaaagaacguaggaauagaauggccguuuucccacugaugggacaauaucgggacuaaaaucuggcugccgaagacauuuuacugcuaacuuaaaagcauaaacuuccguucucagaagaguccuagagccugauuucugcuaaguggcuuagaaaugaccaugugcuucccagagaaaccauagagagagagaguuauugaguacugccugcuguaauucucuuucuuuucuaacagaccucuuuuuccuaaacuguaaguauuccugcacauuagacacacacacacacaggguaagagauuguggauaaaaagagaaaauuuggcgacaggguagauggaagagaguauugagauuauaggacagauuuaaaguugaaauccgcugcauacuuaccagucugaugaaugaacuuccuuuaccggccaaugcaccaaaaugauaaugguucugaugagugaaggaacaccaggguucuugguacucaugcuggcuuagauaaaacgacauggacacacauggagggguuuuaaggagcggagaguugaauaggccagaaagaagaaagaagguagaaggaagaagcucccccauacagagccggggagcugagggggugggggggcuccaaagcugagagagggaauuccccuaccugcccccaccuuuuuuuuuuaagagacauggucuugcuacaucacccaggcugcaguguaguggucauucacaagugauccuccugccucagccucuuaaguagcugagacuacaggcacaugccaccugcaccuggcagugguuaaaaucuuaaugauuaugugggcacaugcuuuauucgcugauggauuauuucauuuuuauuccuuuuuguuuaauaagauagaaacuucuuuaaaagcuuugagaaaacuauugaaaacuuaagagguguaggcaugauuugaaauacaacagaagcaguucuuuuguuuuuauguauuuccuuaaagaagcaaagucucacucuguugcccaggcuggaguacagugguacaaucauaguucauugcagccuuguccugagcucacgugauacucccaccuuggccuccuaaaauucugggauuacaggcaugagccacuaugccuggcccagaaacaguuuuguuugguaaaucaggcagcauagauaccguuugagaaaaaucauuucaauuguagcucuccccucccugccgcaaaaagcuagauggcucuugcaagcugagcgguauguuagauacuggugagagaaagacacaugagcccauagcugccauuugcggggagcuuuacugaugaguauauaguaaagguguaaaugaaggaauaaggaaaaauuugaugggauaguauuauaguuuggccgugggaguuaggaaaggggagcaguggaaagugcugaaacuaagauaaccuuuaaaaguuaguuacaggucuguggaguagacaaaaucaggccaggcacuccagucauaaagauuaaaauggucagucaucuguauaaaaggccauggaagucuuggagaaaggcucaguguaggcuuagggauggggaaugucagaaauaaaaugacagaaaggugaacuagagcuagacccuguguaccaaguuaagcaguuggauuuaauuuuguggcauugaaaaguauuauauuuuuaagacaggacuguuaggugaagucucuaugggguuguuugcagauaguaguaaaauuuauuggcccaacgaaaaaugaacaaauaauggaaggagaaaagugucaucagagugguuaaaauggagcaacguagagauauuagauuugggggugggggaugaauaaggugagcugcuuugcccccucauuacaagcuaguucuuguguauugcacuagugccucauaaaaagaaucauagcaacucugagagguaagauauucuguuuugccuuauuuugccuucugagaguuuacacugaaacaguagaagaugugcuagugacuauaucuuuggcuccuaguacaauauuuaacauuuggaaagguccauuugguagcaccuuccaaagauuacagaaaaccuuguaauuggguuuaaaaucaaauugguauacaucucaaaccguguuucuauuuuuuuuuuuuuuugagauggagucuugcucugucgcccaggcuggagugcgguggugcaaucucggcucacugcaagcuccgccuccgcaguucacgccauucuccugccucagccuccugaguagcugggacuacaggcgcccgccaccacacccggcuaauuuuuuguauuuuuuuuuagcagagacaggguuucaccauguuagccaggauggucucgaucuccugaccuucgugauccgcccgccucggccucccaaagugcugggauuacaggcgugagccacugcgccuggcauggaaauaguuauuuuucauaaaauacaugauuuguguuaacagguagaagguuuaacauuacuguuuugaauaguuuauacauaggcuuuuaggggaaugaaaauauucuaugauacuauaaugacagauauguaucauuguacauuuguccaaacccauagaauguacaacaccaaaagugaaccauaauguaaacuguagacuuugaaugauaaugaugugucaguguagguuuaucaguugaaacaaauguacccucuggugaggaauguugauaacaggaagcuaggcauauguuggggcagagaguauugggaaaucucuguucuccuuccucucaguuuuguugugaaucuaaaacuacucugaaaaaaauaaagccuuaaaaauuuuucaguuuuaauuucuaauaaaaaucuaaucaauagauaaaaccuacauaaauaaaaacuauuuggagauucucacuaauuaagaguuuaaagggauccuaagauuacuuuuugagagcugcucaagaaauauauauucauuaaacucaauuuagaaaaauaauguuaguuggcccuuauccaauugaaauauuagaagcauuuuaaguauuuugguuuauuuucuucuagucuuuuuuuaguaucacuuuuuuuaagcacauaauuguaauaacauugucuauaaaauuuuguguggaauuguauaugaaauuguuguauauaaaauauuuguguucacuuauguucuaauauguuuucauaauaaaauguaaucuucaacaauuuagcaguuguauaaucuacuuaguggguauaucuuaauuuacauaauuuuaccuuguauugauucugauuugggauauuaaaucuuuuucauuuagcacauccuuggaagcuuauuauguacaggcacugcucaugaaugcuuuuuauuuuuuauuaagauuuucuuagauuaagaguugaguggcugaguaaaaagaggggaaugugcuaaagagaaucuugucuuuugaguuuuuuguaguagcaggccauauagcaagcaauuaaaauuaauaggaauuuacacaacucuguuagccagcauaggguuguggaaaguuaugguaaauuaauuuaaagcacuuagaagaauauccuuuucaaugaauaauuacucaguguuagcuauuuuuauuugcuauauuauauuuuagaguugaguguucuuuuuaauuuguaauucaaauauacaggugaccaauucugaaacuucucccaguccccagaccuguaucuccaacagcuugcucaacauuucuacaucaguguccuacuggugcuuuaaaauaugguauaugcugagcauugaucuaaacaaaaucugucaugucuuuaaaguaucuuuauucuuuuuuuuuugagacggagucucacucugucgccaggcuggagugcaguggugugaucucggcucacugcaaccaagcuccaccuccuggguucaagagauucuucugccucagccucccaaauagcugggacuacaggcaugugccaccacgcccagcugauuuuuguauuuuuaguagagaugggguuucaccauguuggccaggauggucuugaucucuugaccuugugaucugcuggccucggccucccaaagugcugggauuacaggugcgcccagcccaaaaguaucuuuauucuucccucacacuuguugcauaguuugaguauaaaauucuagguugaaaauuauuuuuccucagaauuucaaaggauuuucuccacugcuuuuuagcuuucaauguugugcaaguccagaaccacuuacuuucuggucucuuguaugugaccuuuuguuccucucucugaaaguuugcaggauggcuuugacccacgcguccugagguuucaugauaugucuuuaugggucuguuuuuauuuacugugcuggguaucauuggauccuuucagugugaaaaugaaaaugucuuugaaauauugaguuaaugauuuccucuucucuuuuaucuggaccucuaaagugaucuuuaguuuucacaguuuuuuuucuuauuuuccaucaccucgucuuucuugucuuuuaacuuugcuuacuuucagggagauuucuuuaucugauuuacagcuguucuauuugagguuuucaauuuucuuacauuuuaauuuuuaggagucuuuugucuucugauuuuuaaaaacugauaccuuguucuucaugaaugcaauggcaugguaucuuuucucucucaagauauuaauggugguauguuguuuguuuuuaaguuuucaucucauugcauaaucucuaccaaauucauuuaaaugugacuguuugucuuuuucuuucuuaucagagccauuccuuaaaaugucuggugauugauaacugguguugguaauuuagacuagcuaauaaaaagcgaauugaaaugucuguacaaguuguugggacuaaucaccagugguuuuuaacuguaggaugaucccacuggagugauauauugcucaaccucuuaggaauuccauaaugcaaauccaaacaaagugguuuuuaacuuucuguauccaaaacuuaaacuguagcagaugaugccagugcucucuccauaggccuguguuuccuuccugcugucagacuccuagugucuguugauucucaacaucuagcuccuaaggcuuguugcaaggccacccucaccaugccagagccuguuuugccaauguacaugccguggaagugucuggaaaauuugcuuccugaagacagcccuuaaccaaugacuaaugauaugaguaaacucugaggugugaccuacguuaacaccagaacuacccugagggacugagcuaaaauuacccucuaugggaccuuccuuggugucuuacccuugcuuagcuuccuucccuuccuguccuguuucccuacaagguuuuccauagaauacuuucuaauaaaucacuuugacacaagcaccucaucuuagagcuuacugccaaaagacccaacuuaacgauaacuacuacuaauugcucagcauucucuuuaauuggagugaaaucagacugaaguuuucuaugcuguucuuuggguucuguuugucagauaaugucaucaaacuuuuauauuaaagaauaauugguuaauuucugcuccuuaauuuucuggaaugauuuauguaguccaaaaauuauuuuuuuaaagauugagagacuucguccaggaaagucuggaccuuuuugaagucuggcucuuugacaacauuuuauuuuuucuaugguugucuauuagguuguguaucuugagucagauuugauaauuagcuuucuuuuaaauagaaauguguguuucauugagguuuuuauguuuaauagcuauuauacaaaguguuauuuuuucauuuuuucugugaacaugaauacuauuugaauucugauuugaacaaaccaacugcgaaaagacauuuuugugcuaauugagacaguuugauuacagaagacaguuguggaaauuugauuacagacuguggguuagaugauuccaaauaauuauugcuauuuuguuaggcauuuaguaauggcguuauaguuuuuaagaaaauguugauauuuucggacagguauacagaaguauguagaaaugagaugacuuuaugucuaagauuugcauuaaaauacuauaaucauuugaagaaagaauaaaguaaauaugccaaauuuuguauuauaauucaaucuguaugacagguaugugaguuuuuuuuugguuuuaugcuugugugaagauuuuuguaguuaagcuuuuuuuaaaaaaaagucaacugaguuacuuacgugaugaaauuagaacacauacuucuuacaagcacauucucuccuaucccccucuccauuucaguuggcaccauaaugccauuuuugccuaaccauaacauaaauuaauaucauuuuauuuuauggaguuuuucuuucugggauaauaacauuucugcuuuguugcauaauuaucacagacagguuuuucuuuuuuuggagauggagucuugcucugucacccaggcuggaguacaguggcgcgaucuuggcucacugcaaccucugccucccagguucaagcaauucuccugcuucaaccuccccaguagcugggaucacaggcaccugccaucaagcccagcuaauuuuuaaaaauauuuuuaguagagaugggguuucuccauguuggccagucugguuuggaacuccugaccucaagagauucucccaccucagccuccgaaagugcuaggauuacaggugugaaccacagugccuggccacacacagguucuuuaguuuuauaugggaagagauugcaugucuuuugccaagccuuucauuguaugauuucuccauuugugaguuuuauggguuucguuuuuguuuuuguuuguuuuuuauuauuuuggcauguguaucuuauauccugugaccuugcugaauuuacucuuuguagcauuuuucuuuucacaaaauccuugagauuuccuucacagucacauuaucuacaaaucugcaaauagggaugguuucauuuuuuccauuacaaucuauaugccuuuucauucucuuuuuuauuuuucuccuuuauuauacuggcuagaauuuccaguacuauauugaguaagagugaugagaguggacauccuuuccuuguucaugaucuuaacgugaaaacauucagucuuuuaccauuaaguguaccauuagcuguuaguuuuugauacuuguucuuuaucaaguuaaggaaauuccuucuguuuuuguuuuucugagaguuauuuguccugaauauuggauuuugucaaguauuuuuucugcaucuuuucauuugugugaauuuuccuuuuuaguugguuaauaggaugaaucguguugauuuuuaaauguugaaccauccuuacauacucagaauaaacucuacuuggucauaauucuuuuuacauaaugcugaauucuauuuacuaauacuuugugaaauacuaauacuucauuaaguauuaguacuuaacaugcuaauucauacuuuuaaguauuuuuguuucuguauuucugagaaggguaguagucuguaguuuuuuuugguuuuuuuuuuguacugucuuuguuggauuuugguaucaggguaauaugaacuugauaaaaugaauugggaaguguucucuccuacuuuuuggaggagauuguacaaauugauguuaaaacauuaaaaaauaauuuuuagaacaucuguuagaauucuccaguaaaaccaucuggaccuggagauuuuugugggggucaggggcggggggugaggggaguuuuaaaauugugaguucaguuucuauaaauaauuauauggcuguucaaauaaucuauuucauauugagugaauugugaugguuuaugcuuuucaaggaauugguccauuucaucuaacuugucaaauuuauacguguagaguuguuuguaguauucccuuauuauccuuugguaucugcagggucaauagaaauaaccccuguauuauuccugcuauugguaguuugugucucaaucuuuagaggcuguccauuuuauuaaucuuaucaaagaaccagcucuuuuuuuuacauuuuagguucagggguacauauacagguuuguuacagaggugaauugugugucauggggguuugguguauuuaagcauaguguauuuaaguguauuaaguguauuuaaguguauuaagcguauuuaaguguauuaagcauaguguauuuaaccaauagauaguuuuucaguccucacccucuucccucccuccagucuuagguaguuucuggugucuguuauucccuucuuuguguccauauguccucuguguuuaguuacaagugagaacuaauaagguuuucuguccuguguuaguucacuuaaaauaaugccuguuuuaaauuuuauuaauuucugcucuuuauuauuuuauuccuucuugcuuuggguuuauugugcucuuuuuguugagucuugagguagaagcuuaaauaaucaauuuauuucucucuuuuuuaauguaaacaguuagugcuauaaguuuuccucuuagcacugcuuuugcugugccgcucuauuguuuccaaacuguuucuuugcuauuuuuacuucccugugucauuagcaaaacuaaacuccaggaaagcagggaaagguacuugcuuuuugcuuuucccaguauauagcauagugcuguguauuugaaaauaauuuuugagcuuuaaaacuuagaucucagcuuggcagcuuacaucugcuuauaaccaggaacuggaagaaacacaauacaaauauucccuaaaauuagaagaaaacuauagaggguuuauugcaaguaaaauucuacuuaauaaauuuauuuuuguuuguugaaaagcauauggaaaacacuguauggguuaagucuuuagcaguguguuuuuuguguuuaagaauuuauauagagaaacauuugaguuuuuuaauggcaaaauuaaagagcagaggcaugaauauuuagucugaaaccaguuccaaucucucagcaaacauuaacauccucccaguccauucuuagagcccguggacuuuucaauaucuuauuugcaccucaagauuuauaaauagagcaaaagcgguuucuuguuggaccuacugaugacauaaccuuuuaaguauuccauuuaaagauaauuuuagagagaaagggaaaggauauggaaaguuaauagacagcuauaggugcgagagugguguguggaaaaacuagugaacuuuaaaugaaaugggggugaaaauuccaauuuaccauguuggcuggcugguuuggguccauuuaauuaaccugucucauacucaguuucuucaucuguaauaugaaagggauacugcuaucgaguuuucagguugcugugagcaucagaaaaaaacauaaaaauuucuaacaugguaccucacauguacuauauuuguaaauguaaggugugugacuguaagauuuauaucacuuucauaaggaaaaucuuuugggaaaauauaaagauguaucaaaaauuauuuuaauaugguuagaagagggaauauauuuugaauacauaaaugcagcaaaugaaugccauaauccagagcaaaauuagaaguaccugauugucaccuuggcaaaaugugguauaaaguguuaaaauuuaaaaaaaaaaauaacuagaauuucagggcuuuauugugaauuacacucacugacuucccgaaagccugaaaggaagaagacgugcgcucaugguaaagggcauuaaaaucuuggugaaagaauauucuugaacugguggaguggcugaaaaccaagcauaagagaagagguuaaaggcuguauccucagaauucucuggcacccauguaagaagaccauggaguaauauuuacaaaguucuuagggagaagaaaguuugugcaauagcagacauucugaagccugcaagaauuucagauguggcaccgauuagcgccauuaaaaaaaacugcuugcugaaacccagcuaacaaaaacaugauauuaaugaaaaacucaaauuuagaggaguugugauuaaaaaggacucuuguugagcauggaaucuaguuuaauguagauccaggauuaagcagucauggaauuacaguucauaauucauauaauguaaacuauguacauuuuuaccaaauaaaagcaguuaacaaaaauugguuguggcagagggaguguguguguauguauauguguauauauauauuuguacauguguguauccaugcugauuuccacauuucacagcaagaaaucaauagauagugccuaaaauugagcuuauuuaaugagcccuccaacuccuuucuguuuuuuuguaaacuuuucuuaauuuuuagagggauccuuuagaggaugggggucauauuacagaugucuaggugacauucagauuuuuuagauuccuuuauuuccuauaaauucaaauaaaucuaauauguuaauucuuuaaaaacgagaugacuaauauaauucccauucuguaaaacuguaggguuaugguuugaauauuuguccccucuaaaacucauguugaaauuuaauucccaguuuggcaauauuaacaaggccuuuaaggaagugauugguuuaugagacagaccucugcccucaugaaugguuuaauccauuaauggguuaauaacuuaauggguuaucaugggaagggaacuguuuuggcuuuauaaagaaagggaaggccgggcgcgguggcucacgccuguaaucccagcacuuugggaggccgaggcgggcggaucacgaggucgggagaucgagaccaucccggcuaaaacggugaaaccccgucucuacuaaaaacacaaaaaauuagccgggcguaguggcgggcgccuguagucccagcuacuugggaggcugaggcaggagaauggcgugaacccgggaggcggagcuugcagugagccgagaucccgccacugcacuccagccugggcaacagagcgagacuccgucucaaaaaaaaaaaaaaaagggaagaggaacaaaccuaagcuaacacguuagcaugcguaucccucaugccaugugaugcucugugccaccucaagacucuucagaggagaguccucaacagcaagaaggcucuuaccagaugugcccccuuuggccuuggacuuucuagccuccguaacuguaagaaauaaaugcuuucucuuuauaaauuacccaguuucaguuguucuguuauaaauaccagaaaauggacuaagacauaauagcaaagugguuaagagucugaauuccugauucagauugcuagugugacucucugugucugaauucaucuguaaaugggaauacuaguccguacuuuauaguuugcagaugcucuuaguacaggguucaaauguuaacuguaauuaccucuccuauuuuuguuauugcuagagagaaaccuguaaugauaaucacaaaauauuaauaauuguuguuucuggguaguaggacuugugaugauuucuuccuucuaaauccuuuuuuaacaaugaauagcauaaagcugucccuuuaaaaauaaaauuaaaauauaaauuuuaguugucccgggaguucuuuuguaucugaaaccucaguugucaagcuuggaaaucuguacuuuuaaaauauccucaagcgauucugauuacacaucagguuuggaagcacuuggcauaaagaacuucccccacccaauucaaagaaauaguauuuaagcccucauaaugugcagugugguuaagcugugucuuuuuccagucuagucuaccucaacacucuuguggacaugauuuuugccaaaaaucugagugagcuuugggaugcauucuacccccaugagauggcuauuuuaucccaggagcaggaaaaaaaaaaaugggaguuuacaguuauuuagucauaaggccggaguccuuuaaauuggaagggaaugugguaaacacaacacaagaggagccaacacauucugagugugcugauacucugggggagaagaguaagagaguaugacaggcaucagacagcaucacaaaacauuuuaaaguuaaaaacaauuacguaacaccaagaagucaguuuuccuuacauucacuccaggauagaugccuugcuuaaaaagugccucuucagcuaagaaaaacuguguccauaaguacuucaguagcuuuccacaaacaguaacuguuuuuguguuauagaaguaggcuuguucugaagcucagcauguccuuggaauaugauugaguagcauguuaguauucauaguugauggagcuggguuagcacuucuuuaacuucagauauccauaugaugauagaaauaggaauuuucucugguccugcaguccuuccucuucucagucacagugcuuucugccuaagugguacugaauggcauugugacuacugcuuucuucuccagugccaggagcgguagacucugcagcaguaaaauacugucuuuguucuuuucugagauggugaaguggcuguguaugguauuaaggcaaaaucacagcuaggacaaaaagcaauggaaaaccaagaucagugugcuguaaggcaaaguguuagugagagaaucagaggauguagagagugacaacucaguaucugcuaaugcuccagguucacugcuucaaucguauucugcuugucuuccuccauaagaaauuaagaguuaaaacaucuuucauuuacuucucuuggcuucauguuuucaauucaugguacuuucauaucacauaccucuauuguagauugucuugaucauguauacugcuaaaggaaggacuuguauaauaucgaacagauacuugacuaaucaguucucucuggcuguuugaaugaaauuucaaaccaagauuucugguuagagcaaggucuaaugaacugguccucagacaaucgagauauuuagaauuucagaacaaucacuuaagacaggagggauauguuuuauuguaucuuuuggauauaaagauuacacuaacggccaaccugaaugagggaaagggggcaguagggaggcagaauuugagacccccucaucagagaaaacagcagaaagacaugguaaacuuguuucugguuuuccuguggcaaauuugauuggguguagagagaaggaucguugaguggggcuauguacucaucauccaugaaggccuaccuuucugaacuugaagguacagucaggauagagcaaaagguguaaacauguaucugauaguuucagaugguuaauuuacaucucaagauacugggcagcuuugcuuauacugugcuguuccuucaccucuccucuuccucuuaggguuuuucuucccaaacuggaauuacaauucaggagagagccugaaauauaagauauauaaugcagcauaagcaugguguguugucauggcaugucaauuuuacuuguagauuuugggauauuuuuauaucaaauaugaauauauuaaguauguacuuaaugggauaaagacacaugaauggguuuuuguauacacuuuuuacugaaauaaauguuaauacagaaaaguauguaaaaucauaaauguagagcuuaaugaaugucacagagaacaagccauguaacuacuaguuuuuuuugugguaucaauaagcuuuccuuuaauuacuguuuguaugguauauuuuucuauuauuuugcuuucaacuuuauaaaucuauuuaauaugugucucuuguaagcugcauguagaugaguuuauuuuucucgagucuggcuggcaaucuuuauuuuuuaauuguaguuuuuagucuauuugcuuuuaauauaaucauugauauguuugguucuaaaucaaccaccuuacuauuuauuuucuauuugucucaucuauucuauauucccuuuuuuuuuuuuuuuuuaacauugccuugauuugggguauuuucccauuucauuuuuuuguauuugaauuuaauuauauuguuuuacuguuuguuuguuuaaagauuauauuagacauccuuggucuuuuaaaggcuauuauuaaucaguuuuuuuuuuuuaaacaacuccuggacagugaaaugacuuuagagcucuuaaacucuauggauccuccuuauacuuuuugaugccaguuuuguaauuuguuuuaaugguaauaauacuaauaucuugugagacuuucaaaaaauguuuuauuauagccaauauuuauuuggauuuacuuacauacauacccuuuuuaugacucucccuuccuuccuacaucucugaauuuuuaucugaaauucuuuuccuucugccugaagaauuagaaauagaacuguuagugauaaauucacuuagguuuuguuuuucugaacauguuuuuaaggcucauucuugaaggacauuuuugcuggauacagaaugcuagguugguaguucuguucuuuuagcacuuuaaaaauaguucacugcagucuugauucuguuguugcugcuaaaaagucagcugucaaucuuauuacaccuuugaaguuuuuuuuucuguccuugguuuucaguaguuugacugauguacuuagguaacauuuucuuuuucuuuguaaucuucauuggguuuuguagauuuuuaaugugaggguugguacugugucaguuucggaaaauauucagucauuauuucuuuaaauaccacuucuccugaguuaugucucuucccucaaagguuccaguuaacacuuacauuagacccuuucacuuuauucuguuuuuuugcucaauucuuuuucaauccauuuguuuuuccauacuucauucugcguauuuucuucugaccuagcuuuuuagguuauuaauuuuuuucuucagcugugacuauucuaugccuaauuucuuaaucuugccauuuaauuucuugacuuuauuaagaauaguuauuucuaagcuaaaaauaugaaaaucuuauuugagucuuuuggcucuguuucuauugucuacuuuuuuguguuuagccguaauuuucaucuugaugccugguuguuuuggacauuguguaucaaaauuuuguccauguuguauaccaaaaaaaaaaaagucgucaugauaauuugagguucuucaugauuuuauauuucuccaggagaauauuuuuacaguuaggcuagggcggaucauccagucaguggcugagaugacucuaacguagacuucagccguuguaaagauuggucuauuuuuguuuuguucuuauucucagauuguagccuuucagaguccuugauaagagcauagguguuuuucaggaccucuucuccuaagcagacuuuggacauuaauuuuugcuuagcuuuauugcccuugcuguuuucucuuucagaaucagucauugucuugaggauagagcagugccagaugucuggucugccucuuuccuuccuucuuccagauuuuggcccuacuaauucucacugccuugauaucuuaccagugucuucaaacacauauuuauauuuuuuuacauuuuguucaguuuuucugauugcacuugguuguacuaaaagaaccuagucagccauuccagaaauacaugaaguuguuuuguuuuuauuauuguaguggugauuguugguuuguacuuuugcuuucacaaacuauuucaaagcaauuuugauuuuuaggguuauauuucccagaccucuacuuucacugcccauugcccucugcuguuaguggugauuaggugaagaguuugagaaauguaauggaaagggcguggguuuuuuuuuuuuguuuuuuuuuuuuugagacagagucuugcucugucacccaggcuguaauacaguggcaugaucucgguccugcaguccugccucccagguucuagugauucuuuugccucagucucccagguagcugggauuacaggcacguaccacaacgccuggcuaauuuuuguauuuuuaguagagaugggguuucaccauguuggccaggcuggucuugaacuccugaccucaggugauccacccgccuuggccucccaaagugcuaggauuacaggcgugagccaccacgcccagccgggcaugggcuuuuuaagcacacagaccuacauucaaacuguggcuccuucugauugugucagccuauaugaauuaauuaccuguuuaaaauuaccuuuuuaaaauuucucuuuccucaucugcagacggguuuagugagaaugaaaaaggacauugaaauuaaauuuuauuuaaaaugaaauaauguauggacagcuucugguauauaauaaaugcuuaguaaacuuauuuuuuuaauuaucuugaggaauaggaaacuagaguuaagaccaaucuuuuaaggaauuuaauagaaguuuauaacuucaccauauaguaauuguuaacaaaagcuuaaaaagggcguuuaugucaauguuugguuguggggcaguucaacaggcaucugugucccagguacccuacuuaaucucguuaauauuauagauuccauccaaaaucuagaucuugcaguauagagcagaggucagcaaacuuuuucuuuuuuuuuucugagauaguuucacucuuuugcccaggcuggaguugaguggugcagucuuggcacacugcaaccuccgccuucugaguucaagugauucucccaccuuauucuuaccaauucuucccaaguauucaccuuauucuucccaaguagcugugacugcaggcauaugccaccaugcccagcuaauuuuuuaccauguuguccaggcuggucucaagcuccugacuucaagugauccacccgccuuggccucccagagugcugggauuacaggcaugagccacugugccuagccagcaaacuuuuucuauaaagggcuagguacgguuuugugagacauauugccucuauuguagcuauucacucugcuguuuuagggcaaaaguagccgcagucaguauauaaaugaaugggcauggguguguucaaauaaaacucuauuuacaaaaacagguagcaggccagguuugguccauggguccucaaacugugcugacccuaguccuccacaagcuacaaguguuuuuuuacguuuauaaaggauuguuuaagaagaagaugcaacagaaaccacaugagacccaaaaagccaaaaauauuuuauuucuaguucuuuacagaaaggguuugcuaacuuuuggguuggagaagggguggugguugcuaccagagaaaaagaaguagacuuccguacucagaguuaacagcaaagaaagaaaaacaacacgacaggaagcccuggauccacaaaggauccuggugggaagaauaggaaauucugugugcaauacugacauacucauccauaccccaccccaacugugacuguccuacuaauuaaucugguuuuauggauuuuccauaaugugcuguuuuagcagcaaauagagggguaaacucauagauaauagcuaaauacuguuagaaauuaacuuuccguuauagcuaaauguuaccagaauuuuuacuccgguuauguauacagcuuugauuuuauaacauccugcuaauuuuuguucuuacagaaauacacuuucgggaaauggccucuaaauccuggcugaauuuuuuaaccuuccucuguggaucagcaauaggauuucuuuuauguucucagcuauuuaguauuuuguugggagaaaagguugacacccagccuaauguucuucauaaugauccucaugcaaggcauucagaugauaauggacagaaucaucuagaaggacaaaugaacuucaaugcagauucuagccaacauaaagguaugguuuacuuuauuaagcaguaaacauaagcaguauuuuagucuaaauuuugucauauuccugucuguaucuguuaauuaaaaugggcuauauauuccagauauuaaaaauaauucuugguuugccucaagagaagggaauugcuaaaacucagauuuauuuagggaauaagauauuaauuuugaauucguuuuuaaguagaaauaguucagaacccaugauuuggggaagggcauaacuauucagauuugauuuguuucugaaaauguuuuucuagguucaguuuuguuauaugugugucuuugguuuuuguuacuuguuuuggucauagcuuuugcuuaagucuuguuuuccuagagaaacuugagguguauguaaguuucgauuuauauuuuuauaauuaguuaauagaacuaaucuuuuuuuuccucaagaggcacaaagaacaaggaaguuaaaaaccaaggaugcguucuaaagacuucauuuucuccuagccuccuaccucuaaccagauuuucucaguugaguuauuuaugugucccuuaaguguugguucucuccaaguuucuguccuuuagcuguuugucugugugacaucauuaacccgcauaauuuuaauuuccuucuauuucuuacugucuuuagcccaguuccagacauugugaggugacauuaacacaaugcaaaauacgguuugacagaaaauaauauaaguagcuugaaaacaauuggaauucugggaugcagaggguccacuauucaguuuuuucucuucucuucucaguaguaaauuauuucuucaccaccucucaagcagagguugaauggugagauuucaaagccugguuccauuuuaucaacuagcaaacauaaacauacuauuacaaaguaugucguguuuugugauuguuuauguaacaguaauucagcucugagcaagugcucuguguuccuacagaacaguuuggucacuguguauuugcucuguagcauagccacaugucuuuaggugaucaauuggaggcagaguucccuacuaauaguaagccguacgaggccucacugcaggcauguguauuagauacauacuuguccagcucaguggccuacaaaaugugggguaugcuaaaaguuugucuacucccuucagacucagcauguguaaauugagucuccuuuuccuuccuacuccuagaaguugcucuuccuccucuauucuuucuuuuauauggcucauuaccaucugucugugccagaaauuaagaaaucaugguaggugcuugccuucacaugcuagccaauucgauuugucaguacauucuaacagugcugcuacuuuaccauuuuucaucucuuuuccucucaguccucagugcauuuccgauucaggccuucagcuauacccauguaccugcacucaaccaaacuucaccauuccuuuuggugaacuuauaaccuauuuucuguauuaugucuuuauuuuuuaaucuuccucuuuguucuaccuaggucccuaucuacugcucuguaggauuuauuagccacuauuuuccuucagcacauugaauccuuuguucauaccucuauaauaacaucucuuaguauuuagcaauuauugguuugugugucaggcucaggcucccugaauggacugaauuccucugcagcaggaaaugugucuuacucauuuuuuucaucuccuaugccagcccaugcccaguacaaagcaauuagugaaugaaaaauuauuuaucaaguucagcgguggacaaaccugucuuaccugaaugaaacagauuggggauuccugcauucacuguucuauccauucaagguuugguauauuuguauagccaagagauugggcuccucaaggauaugagaugucuaugcuuucugacugaaaguagggugauuuugucugcuguuguccuuuuggauugugaaucuugauacucagagggacaugagaauuuuuauuuuuuauuuuuuuugagauggagucucgcucugucacccaggcuggacugcaguggugggaucucggcucacugcaaccuccgccucccggguucaagcaauucuccugccuuagccucccgaguagcugggauuacaggcgcccaccacuacgcuuggcuaauuuuuuguaucuuuuuuaguagagacaggguuucaccauguuggccaggcuggucucgaacuccugaccucgugaucuacccgccucagccucccaaagugcugggauuacaggccugagccacugugcccagcugggacaugagaauauuuuuauguuccacccagcuuuucccauuauucccucucaguugguuaacuaguauauuauaugccuccauuguuaauuucucauaggacuaagcuucuguaacuugcuguuugaccuuaauuuuaagcauaugcuucgucaggauacugcccagaacauugcuacugaaagucaguucauagacucauucugguccuauaacuaaagaaugucugcuuauuugggaguaagcagaaacuuuuauuguaauuggaguaauuuugucugaagcuaaaaauaaaaauuuaggacuuguuuuauauuuuaguuuuauuuuucuuauaauucauuuuuauccuauuuacacaguguagaccucuuuuagaaauaaaaauuggccuuucaccacagauagcuugggaaguacucaucuagaaucucaucauugagcucuuccucuguaccggugcuacucaaaaugcgguccuggccugacacuuugucagcuguuugucugcacaagauaaugagguuacacuaggauguaaaucaguuuuacgcucacugcuuacuuaaauggacaguuuuaaguuucaguuuuaagcucacugcuuaguuaaguggacauuuugauugguugguucugauaguaggccuuuuucaaaguaauguguugcuuucuguucugguauaagcuccuuauuucuuugcaaaccuguaguuuaaagagcacugcucuagaccaucuuggaauucccaugucuaccauuguucucuucuguuuuugauugguggauuuacauuuuggaaugagguaugugacuaucagaaaguaaucucaacuccugugcuuugaccuuuuaccaccucaggguacuuguagaaauucuuaauaguggauuauugugaacuucaaaaaugaacugccacuucagcagcaugucuuuccugcucuucagaaacucguucagagcagugagaaauuucugucaguaaucuauuaaaaacuggcugcuuucuuuuaugaagugccaagcagagacuauuuaaggcagcauuuagcaugccuaugaagcaccaggagaacuuauuaaaaugcugauucugagucaguaggucugggccuaagauuaugcauuucuaacaggcucccaggugaugcugcugcuuuuaaucaguaaacuacaguuugagacgaauuuagauuauaaugucaacucuuacuagcuccagugauguccuagauaacacugacaugaaaccaauaaaucagagugucaguucacauuaggaugaguuugcuuuccuuuggcuaaaucacuaauagagggauaaauagggacuuugaaauuaggacagugcuuucuucaguauaauuuauuaauauuuggauuuuacaucuauguaaauaaccuuuuaaaauguuuuguuuaauagaugagaacacagacauugcugaaaaccucuaucagaaaguuagaauucuuugcuggguuaugaccggcccucaaaaccuagagaaaaaggccaaacacgucaaagcuacuugggcccagcguuguaacaaaguguuguuuaugaguucagaagaaaauaaagacuucccugcugugggacugaaaaccaaagaaggcagagaucaacuauacuggaaaacaauuaaagcuuuucaguauguucaugaacauuauuuagaagaugcugauugguuuuugaaagcagaugaugacacguaugucauacuagacaauuugagguggcuucuuucaaaauacgacccugaagaacccauuuacuuugggagaagauuuaagccuuauguaaagcagggcuacaugaguggaggagcaggauauguacuaagcaaagaagccuugaaaagauuuguugaugcauuuaaaacagacaaguguacacauaguuccuccauugaagacuuagcacuggggagaugcauggaaauuaugaauguagaagcaggagauuccagagauaccauuggaaaagaaacuuuucaucccuuugugccagaacaccauuuaauuaaagguuaucuaccuagaacguuuugguacuggaauuacaacuauuauccuccuguagagguaaguuuagaaauuuuauuacuaugucaauacuuggacugacugaauuuuguugauaaaaacauguuaauauguguauguuucuuuaguaccaacaacaaggacucuuccuuagucuuuuuaaauagaguggcaguauaacaaaauagaugagaacagggacaucagcaaucagcaguagucacuuagcaaauagcuauugaugcuguuauaugccaggcacugagaauguagaaguaaaucacagccaauuuccaguucucgugaaccuuacauucuggaugaggagauauacaguaaacaggcagacuuguaaauauaaaauaggauuuuaguaguaagugcccugaagaaaaauaagccaaguaaggggauggagagugacccagagugggauggaguccucugguuugggugauuaagaaggccucucaaagaggugacuuuugagcagaacccugaguguuauuagagagcaaguugggugaagaucuggguaaagagccuucuagucaucaggaggauuuaauggagguucagaaagaccuagagucaaauccugcucucucacuuaauagccgaacaaccuuggauggacaggagccuuggaugacaucugagcuucaguuuccucauuuguaagauggacauaauguaccugucuuauuuaguuguuguaauuacaacauaguacagcccuucacacaguaagcauuuaauaagccuuggcucacauuccugagaauuuuaucuaaagugcauuauuuuaggaaguauuccaguaguacaaauauuucagaauauacauuguacuuauccccugucuuuaccaaauauuaaucuuuuugccacauuuguuucaguuauuuaaagaagaaaaugcuauaguauuguuuuucagauuuuuaaauaaauaucuuucuacaacuugcccuuuucacacaacauugagauuuaucaauguuaauuacaugucugcuguguucacuauuauaagcauugcuucagugaauaacugaaugagaccaggaaucauggaaccuagcuuuuaggcucaguucuguuacuaauaaugccuuuaggcaagucacuaguucucuaugccuucuuuucuguggaccuaacguauaaauaauacacuucaugcuacuacugucaucuucauaaggcaaugcuuucaaaucaucaucuggaacagugauucucaacccagggcaauuuugcccccagaggacauuuggcaaggucuggagacauuuuugguuguuacagcuaggaggcugcuacuggcaucuaauggguagaaacccacuacauuauaaaccuacuaaaugcuaaacauccuaaaaugcacaggacagccuccuacaacaaagaauuacucuagcccaaaaugucaguaguaccaugguucagagacccuggccuagaacaucugacccaagcuuuagguaaucagcuuuaaaaggaaacuuuugauagucuguuuuucuauuuuagugagaguacuacuuuggaugcuuuuuugauguaaacuuuucuuaauauauuuugaccauuccaagaugacuugaucuuuuuuccuuaauucuguauccuuuucccauauaaaaaauuuacccaaauucaagaauauaaacauguagcaaauacauccaaaugcauauaagaucuuacuaagaguaucugauguuggauacacauacaguaguagcaaagggacaucauaauuggcaaauuuguucuuucucuagaaauuuaucaaauuauguugaagaccauaaaacagaauuagaauucagaguaccaaaauugacccaucaaucugacauugccuguucucccucaggagauucuuacauaaacccaacgugaaacuaaaauucuauuauuauccaucuaucauuuaguaaguuuucuucccccuaaaugaguuuaaaucuuauacauacuuuuuuuuucuauauacuaauuacugaaaauacagaaaauuuuuaucuagcaagucaggguaaaagauauucuaauucaugaaagaguuacauuccuaaauuucuuguucagaacugacucuuaagcaguucccuucccacuccaccuucuuaguaauagacuuuucaccagagaaguugcagugagucuuaauaugguagauuuaaaauauauguguaauuguuuacauauauaucucucuacaugaaaaauugacuuuucuguaggucagaaauggucaaauaugaucuacuuuauucaguuuuauuuacauuauucuaucugaaacauauuaguacauaagugagguagagagcuccugauuuuuuuaaauuguuaacuaauuauucuacuaccauuuuuuaacucauuacugauuuaaaaugucccccuuaucauacacuguaaccuuacuuauaguaggaucuaaaucugggauuucauuucuaugccauuguucucauuugauuuuggcccagcaccauauuguuuugaaccuuguagcuuuacagcaguuuuaaguuacuauucuaagggcaaauuaacucuucuuuuuuucuaaguguuuuggcaacucauuucuuuaucuuugcauacaaacucauuaauuuagggacaauaacaucuuugcccaggauuuuuuguaagucaccuuuuagguccuuuggucaaguuuuauaaacuauuuccauagguaugcaauauuuuuguuacuguucuacuugggcuuuuaaagacuuaacuuuuuacugauauauaugaaaacuuauuuguuugauuuucuuuuuaagcaucuuuaaaaucuggcuuuguaacugaauucucuauuucugaugauucuucacuugagauucuugaguuuuuuuggguaaccauaauugucugcuagcucuuguuuucuaauaauuauagcuuuuuacuuuuauugucuuuuauugcauaaaugcuuaacagaauccuggccauccaguaaaauauaaauaaauaagagcaauauaauuaaugcaguaaaucuuaucaaaaauauuauuuuacagaauauaaaaauugcuuccagaggucagcaauuuauaacuauuacuggucuaguccuuaaguuuaauaugcacuggacaguauaguagccacuaaguaugugugguuauugagcacuugaaauguggcuaguccaaauugagauaugcuguaaauaaaauacacaccuaauuucaagaaagguuucauuaaucaucgcaaaacuauugcauguuaaaacaguaugaugaacuuuuucaguuaaauaaaaugaaauuucacuuuuuuuuuuuuuuuuuuacauuuuuuauguggcuacuauauggcuuacauaucuguuggacagagcuaguuuagauaaucacaaguugacuuaucugguuauuuuuccuauuugcuuuuauucugauauuuccuaaaggugcaagaguagguugucuaagaaucuacauauccaguguguguuucaaaggaaaguuuagagauaacagcagagaaaacgcaguggacaguuugauaauuuuuacacacuguaagcuacauacuuccaaacauaaauuauuagauuuauuaaauauucagucaauaugaaucuucucuuggaacuugccagacuaucucccucauucuuuacaaagaugucagauggagccugaaguuuuguuggagucaccuggaugacaccaacauucuccagauaccaauucugacucuagguugacugcuuaauucaucucuuuuucugucuucuuaauuuucuugcuuucuuguucguuguauuguuguuguuuuauuuuaaacuuuguucucauaccaacccuauuaggaauuuaugagaauuacauaacuggacaaagguuuaaaucugaccuaccuuagggccaccugauaugauuuuucagucaauaauagcuaacauuuauugggcauuuauuuuaagcaaaggguaauuuacacacauugucuccuuuaaauaaccaccuuuuacaaauguggaaauuaaagcuuauagagauuaaauaacuuacucaaggucguauacuagcccacaaaauuuggguucaaacccaagucuagguugagagcuuugucucaaauacuguacuguuuggguugauacauauauagaugaaguguauuggguuguagacaccuaaugggcaaggcuuuguagucauugaaugcccuagagguauguuuccgaguaugagccacacaaaaaauuacagugagaaaaugaggaagagaaagcagauguuggagaaggagauuucuccuuguauagcugcuccuuugauuugaagaaaucucaguaauuuuauccgcuaaagagugugagagaauauuguuucauuuaaaaauacuuuccacaguuucacuugguuucaccaauuucaauugguuuuaaaucauuaggaugucuaaguaaacuauugauuucuuccacaggucuaguacauuagguuccucugcuuuaccuugccaucuuuaauguuuguauucuuuuaaaauuagcugguccuuuauaaguauguaaauauuguagcuagcaaugugcuguuuauuaacaauaccuguuuccacuacuuuuuuaggguccugguugcugcucugaucuugcaguuucuuuucacuauguugauucuacaaccauguaugaguuagaauaccucguuuaucaucuucguccauaugguuauuuauacagauaucaaccuaccuuaccugaacguauacuaaaggaaauuagucaagcaaacaaaaaugaagauacaaaagugaaguuaggaaauccuugaaagaaaaucaugaaugaacaaagguaauaugucuagcacugcacugaaaaaggacuucugcauuucugacauagaacacuggaaucccagugaggaauucuaagugaacauuccuuauagaaaccuuucacaugaaugacuauaaacugaagcuuuaaaugagcugugaaguguguuaaaauguguuuugauacaguaauauauaaauaugucuauauauaugaggaacuuguguuuuuuaaaugguggccagguagaggaacuagaaaagagauuuuguugccuguuuucugaccaucuguguuauugucacugagaaacuaaaauaguaaauuuacuaaaacuacacugcaccauguuaguaauaaacagaucugccuuaaagaaaagaaaauuuuagaaagaaauauuguugcucaguguuguuaauauagcucaagaauugaguuuauauuugcaguaugcuauaaaugauaccccccuaccacacccacacacacaguuuuugucuaaugaaaauguugcugugauuauuuauaauugguaguauuucuuccagaagaagcuaaaauaagacuggcacuuacccugaagugcauuaauaaaaccacacuuuaaaauuaucaugggccuugacuauauuauauacuugauucuaauuagucaucuuuuacgcaaucucuguugucucuuuucuaaauguguuuagccacucuugaauaccauucuccacuauuaacauuaauuuacucaaaccguucauagcauucuguaaacauguauuuuacauauuuguucccaaauuugcccauuguucauuauggguaacuaauaauaaauuuaaugcuguuucaggaugcuuuucuuauaacagugccacucucaggaauuacuaagugacauuuuaaauugauauuuuaaacucuuuccaacuacauaguuaugguuuauuucauucucauccuguugggaugagaacuuguuugugccuuucauaacuuguuuaaagcagaguuuuaaaauuaguuuauaggaucugagguggcuauuaguuacaguggcaagauuauuuagaaagcaagauuuugaugagaauuaaaaacaauagaaaauguagagugcuuaaacaaaaauguuauauuuugaaagaguagauacuuaauuuauaaauaacagucugaagguuggugcuauuuugggauaauuguuuugcuaauggauaauucuaacaaugcagaauaccuagucaagacugucaucaaaaacauucacaaauguuucauucuauuuuuagugacucuguuuaaagaguuucugaaaggaaagaaauuuuuuauuuuuauuaucuuuagcaguacugagugucauagcagaauauuuuacagacuuucuaugagauuauuuuuaugguacaaaguauuuacauuucccucauguuuaucauuaugccaauuuuacauggcagucaugccacugacucugcuauuuagcuaaguaauuucuuuuuucggagacugucucacucugucucccaggcuggacugcaguggugcgauucuccugccucagccucccgaguagcggggauuacaggcacgcgcugccacgccccgccaguuuucauauuuuuaguagagacaggguuuugccguguuggccaggcuggucuugaacuccugaccucaggugauccacccaccuuggcaucccaaagugcugggauuacgagcgugagucacagcacccggcuaaguaauuucuauuuauugugccaaaacaugucaaaaucaugaccucuuugaaugguauauuugagaggauguucauuucauugguuaaccauggacuacucuguccacguagugaaaacaugcaccaguuuuuaccuauuaucaugguaguaucaucugccaaaauuucaaggcauucauuuuauucuuugaacaacucuucaccaugguguggacaugaauuuucauauguguuacuugacuagaaguauaaaugguuuacuauagauauccaaaaaccuugagauuugcucauaggaaaugaauauugugaugaauccugggcucuagagucagacuugcuuggguuuaaauucuugcucuaacacuuacuguuuuuguaaccuugagcaauuuuaaucucucugugucucaauuuccucaucuuuuaauuagggaugauaauacuaccuaccucacaggauuuuuaugaggauuaaauaaauguaagguuuuuagaacauugauagggagcaauaaauagaagauuguauuauuauucuguuaccuuggaguguaaguacugcauuuaagugaaugaaaaauuugcuuugaccagauacugaaggaaauaaguaauagcuaguauuuauccaaugccaacuguaugcuagguacugugcuuagauaaucuguguauaauaguguuaauccucaaaauuuggguguuauaccccuauuauagauaaggaaacugaggcucagagacaaaguaacuuugucacugucacaaagcuaguaaguaacagagguaggauuuauauucaaaacccuguguguucauuggaaccguaucaggcuuggggcuauucauguagcauuauuuccauuuuuauguauaugauauaugacgucugaugcauuggccaguaauagucaaauuaacccagccaaauugucacagugauucuuaaacugugguucucacacuugcccaggauguuguuaaaugcagaucugaagaccccaaucucagaaauucaaauuuaagcauggggcccaagaguaugcauucuuaccagauaccuugggcagugacugucaaaagucuggucccaacaaacagcauuaacgucaccugggaacuuguuggaaaugcagccucucucggggccucaucucagaucagaucuacuaaaucagauacucuaggggcaggggcaggggcaggggcuagcaguuguguuuaagcaaacucugcaggugucuuucuuauccuaguuugagaaccaauacccaacaaccuacgugauuuuggugcaaguaguguuugaaacacacugaagauuacugcccaauuacuaagacauuuuucaaaaagcauguuuuaaaucaguguaguccaggaucacacuauauuaaauauaaagauaacuuaaaggaucauuggaucauucauuuuggccaaauuuuuagcuucuccaaagugacuaacaucagggccuacaauaaaaucuguaauucuccaaguuuaguaauuuuauauugaggcaggaagggcucauuaaguacuaauaaguacauaauuuauuaaaaacauacauaagugucaucaaaaagguccacaauuguuaguaaaaaaaauuaaauugaaguaguaaaugcuguuuuauaacauacauuuuucugcuaauucauucuguuuugugugaccuaauaaagcaaaagaaaaauaaaaaagcaauucuccaaguacuucauagagcacauaaaaccagauuucaugaugaugauguauucacuaucuuuuagauuaagaucuuuguuauuugguaaaugauuucaguaugguuuuaaaacauaaggcuuuugaugucuuauguucucuaauaaugguaugcuuguauuuucuagugggaaguucauagauaaagcagauuuuugucccaguuugcuuucaaauauaaauuucagagggcuuuuucuuacuguaaugagguaugaaaauaaaucauugaucagcucuuaauauuuuuugaauacagaauuggauuugagcaguaaauuugcuaacugguuauuuucacaauuuucuugaauauuaauuuuucacuucuuugagacugucaaacuauaguuacuaccagguugaugcacuguacuugaaagaaucccuugauuaaauuacaucuagcauuuuauuugccauuucaauuuucaguucauuagacuauaauucuuugacaguuucugccugguguuuauugcccuucuuuguuugcuuuauuacuaacuuccauuuucuaguuacucuuaaaugcugccuucacaagguuaauuuggcuguuaauagugauuagaauuuuuaucacuuaauugauaauuuuaagccuacuaacuaggguucccuaugaaauugaaaguaaaagucuaagaauaaugccugcuggcucucgagauacuugcccuacuuaaaaaucuauaauuuaaaauuaauucuaugucuacaauuauuaaaggaaguaaaguuauuuggguucuuccacucacccuuuucucaaaaacaacaacaaaaaacaaaacucauuuuauuuuucuacuuuauaguaggccugacagaaacauagugaagcaaucugggaggcaaccugugguagauuuuaugcuaaauguuaauguaaccucuguugauuuuuuaaaaauguguuuauauauaagauuugaaauaaaaacuuuaauacaggcuagaauaaggaauuuuacaaauucucuuuagagcaaccaacauuaaaguuuuagaguugaauuuugcucuauuucaacucccuuaccucucuaguuuucaguuuauauuaaguuuuaauaacuuugcggggcccugcaaauuaauaaucuacaugaaguauauuauuagagggaaacuaaucuuacugcuaagcaguguguuguacuacauagugaauguucguguuuuggaauuuaaaaauuauuuaagguaaugguguuacgaaugguuuaaaaaugucuggugacuugcuuauuuuuaagugaucaccauuaagucagaaaaauguauuuuuaaauguuucuugaagugccuuuugaacauuuuuaaacagcggauuuaaauaaugcauaaaauaaauugccauguucaaaguug

SEQ ID NO: 191584 - RNA, 24692 nt, Homo sapiens
aguuugaccccggcggcguuccguaccgucgcggauuucggcggcggaaacauggcggucgcggccgggccgguaacggagaaaguuuacgccgacacuggccuguauuagcgcguauggccucgggcccucguuccccaaggcgugccgccucccuguucucagucgcaggcugaagccuugucugcucuccuccuuuuugguuugguuuuggaacugacuccgaggguugggagagcgcguugguggcgacggccgagucagguagggagaaauggguggacggcagggcggcgagaucuaggcauagacacugccagggcuccgcgugguccggaccccaagcuccgcccagucggccucccagggccgggguaggauaccugccucuggaggaguugacaguggugguuggagauuggagggugugggagcgccucuccguauuucgcaaggguucccccucaacugggcgccacguuguggucgcguucuccgaggcagaggaugguggagaacagccaagcuccuugucggaccucccacaucucgcuagaaggaggccgaaagggagagaaauugcuguugcugcucuagugcugaggaguuugauauucuagaugacauuuuccucguaugagauggcucaaagaguuaucaguaauucagaacugaagcacugaaauucccuguuuuuucaguguaguucuuucagccuugacacuucuagaugggacagaguuucugagugaaagauaaugcaagugauacgguaugccucaagccauucccuagagguaggacauggagagagaauugguuuggaagaauuugggugaauuaaguaaagacugguggaaagcugaaauagaaaccaaacauucauggacucucccuuaguucuacuaguuauuaguugugggauauagcuaaguucuguauucucuuuaggcauuaguaaguguccaauggugacuauuguuguuaaauguaguuauuucuuuauuagucuuuauuuuucaacaaguauuuauugaauaccuucuugaugccggauuuuugcuagucacuggguguacaguauugaagacaaacccucagagaccuuuugaucuagugggaaaugcagacaugaaauaagugaugguauguaacagagaaaguaugggggucauguaauggggagggggcagggauaaucucuuaagaaaaugauuuaucugagaccugaagaguuggaauaagccaggugugagcacugggguggggccaggaggaggaaaaggaguguaccuggcaagggaauagcauuugugcaguuuguaauugaaaggucaguaagguuggaaaauaaagugugagaggaaaacugguaacagauaaggcaggagaguuauucaggcccaacacggagugccuuauaaggcacuguaaggaguuuugacuuuauugcuaagggugaugggacgccauuggagcauuuuacauaguggagugcuaaauuuugguuuuaaaaaguacacuucuuagagagggcaagaguggauacagggaaauguucaacaugaugguggccaaaauugggauggugacccuggggacgagaaguagaaacauuuaaaaaauguuuaggaagaauaguagacaggacuuggugaggauuaaauguagaugaugguggagaggaggguuagaauaguauguaagguuuuaugaaauaaucagacucuggcagugauugguuagcuuuucccauaugcauauugacuccucuaugguccauuuucaucuaccucuggaauaauuguccauugaaucauuagugacggcaaaccgauugaaaaggaauguaauguuuuucuguuauucucuaacucaggcugucuuuugaagaagaucagaauggggaagaguuuuguaaauuagccauuuaaaaacaaucugccauguugauuuugguccauaggaagguaacugcauauauugcauuauauggaugcacuguacuucacuaauuuuuuuuuuacauguuuacauuuacuuuguuuccagguauuuaccucuguuaacagugcagaacagagcuggugcuucauuuucuauagguagauuaauauaugugugcacuuaaguagagagauaauaaucaaagacauagaaauaaaugacauugcuuagagaaaguauauagugagagaaaagccuagguuugggguugaacauccaaaggauggguugagaaugaagaaccuucaaggagaccgaggaggggaaaccaauaaauuaagaaaaaaaaucuggggaguuagucuuuggaugccugcaaaaaggaaugguuuggaaggugagagaagucaacaauguaaauuuguuuaaagaauaugcaggauauggccgggugcaguggcucacaccuguaaucccagcacuuugggaggccaaggcggacggaucaccugaggucgggaguucaagaccagccugaccaacauggagaaaccccaucucuacuaaaaauacaaaauuagccgggcaugguggcacaugccuguaauuccagcuacuugggaggcugaggcaggagaaucgcuugaauccgggaggcagagguugcggugagccgagaucgcuccauuguauuccagccugggcaacaagaaugaaacucugucucaaaaaaaaaaaaaaaaaaaaaaaaaaaaaaaaaaaaugccagucgcaguggcucacgccuguaaucccagaacuuugggaggcgaggcggguggaucaccugaggucaggaguuugagaccagccuggccaauauggugaaaccccgucucuacuaaaaauacaaaaauuaacugggcauggcgaugggcgccuguaaucccagcuacucuggaggcugaggcaggagaaucacuugaacccgauagucagagguugcaggagaaucgccugaacccgauagucggagguugcagugagccaagauccugccauugcacuccagccuggacaacagagcgagacuccguccccccuucccccuccccccaaaaaagaauaugcaggauacugagugaaaaguacccauuggauuuaggaauuuacaggucauuucaacacuuagcagagcaguuguguggugggaaacaccauuuagugguuugaaaagugaauggguaagaagugaagcaacuaaauaccagcugucaaaaggacacgagauugagcuucauagaggauauggggaugagcaaggauuguuuuuguuuuguuucuuuacuuuuuugguauuguuuuuaaaagaaacagauuuauaaauguuuaaauacuaauggauaaaauaaaagugagaguuugcagagagaggagagagucugauguucuagaagaggcggaaggaaagaugcacaauauggcugaaagguuuagccuuagauagagaagcaacugccuucuuuccuuauauucggagauauaaguagagguggguuuguggacuuggaaacucaagugagcucccuuuugaugacucucuaggaggcagagucaucuggugagaaugcaguaggaagaaguaggguaucagagauuugaagagaggaaauagggguuugaauagucacaagaauggggaagaauguugaccagggaaggauguuccauggauuuagaguggcaccauuuagccuaguaugugaauuucuuccccccguccagcaguguucaguagucugagcccagauuguaccaucagcucuuugaggauauauauucuaacguauuuguugaauuauuuuauaacacacauuagugauguuuaaaaaaaaaaaacucaaugcauuccagauuuugucaguuucucacacucaaguuaaaaagauaaaccaaaauauaccaaaggaagacauuuucuuuaacauuaugugguaccuuaagacaugagugaauaaagauguaauuaaggaaaaucaguuggaauacuuaaauagacuuaguuguaaaaauaaaaaaaaaugugcuuguugaacguauaaaagcaaaauaaguaauaauacucggaacuucccagagacccuaagguugcuuuaguaacauuccucuccagccagaugaguacuaagaguugauuccagguucucauguuucucuugagccuuuuaguguacagcuauuaagaaaguacaaauaaacuaaucaaaaacucguggguuuuuuuuguuuauuuuuggaggcagagucucgcucuaucccccaggcuggaguccaguggcgugaucuccgcucacugcaaccuccgccuccuggguucaagcgauucuccugucucagccucuugaggcauuacagaugccucccaccacaccuggcuaauuuuuguauuuuuaguagagacaggguuuugucauguuggccaggcuggucuugaacugcugaccucaagugauccaccuuccucacccucccaaaguucugggauugcaggagagagccaccgugccuggcccuaguuucuuuuuaaauaucugauuggguucucuuuagauagcauuaccgugaaccauugaucaguucuuuugaaacaguauacuaggaaauuuugaagaauuauuauagaugguuaaaucauuuuuugacuacuaucauuuuuuaggugugacuuguggaagcuuuaauuucguggguccacuaacaaauacuuguaguaacguuuguuuaaguagaauugaaaaguucuucauuuacuuuauaaugacuauuagggugagcauuucaguuuuucauuuuugacucggaauuugucaggaauugguuugcuauagagauaguguuuagauuuggaaagcaaguuuaguaaucaaaguaauuuaauagagauaaaaguacagggagaauuauggcucaacuuuagggacugaguaacuuuaauacuuuaauucuaguaaguuuauuaguuaaacaauguaaagaccuuguguaacauucuagagcuggcuuguaaaaagauguaggggauauuuggcaggucguaaugguugcuguuacuacuaauauauacaagugcuuuucaaauuagagguaacgaugaaguccuucauucacuuuaagaacuaaguagcuuucucuuguaccaaaaccugcuacaaucuaagcuaaagcgaacauuucaccuuuccuuguuguugaaaaaccagauauuuaaaccagaaugaauuaggugaauucuucaccaucucuggaagaacaguucuauucaugcagucauagcauaugaugaguagaaagcacagccaugucugucuggauaaacugccaaguuuuaagccagaaacaguauucauuaagauauugcaaaucagguuguaaacuggauuucaguuuuuaaacuggauuuuuucacuuucuauaugcaucuuuauauaaaauaaugaguaaauuauauaaaauuaacucugaaauauuguuuucuucuuuuuagaucacuauaaacaaaauuuccacaagagaaaauguugaaauaggaguugcggauacauuggauauacuggaugaaauacaagcgguuaauuuuuguaacgugagggaaaagcccacauugcugguuacauguguaaaucacugcguuauugcuuuagucauugucucuauuuagcaaugacaagacuggaagaaguaaauagagaagugaacaugcauucuucagugcgguaucuuggcuauuuagccagaaucaauuuauugguugcuauaugcuuaggucuauacguaagaugggaaaaaacagcaaauuccuuaauuuugguaauuuuuauucuuggucuuuuuguucuuggaaucgccagcauacucuauuacuauuuuucaauggaagcagcaaguuuaagucucuccaaucuuugguuuggauucuugcuuggccuccuauguuuucuugauaauucauccuuuaaaaaugauguaaaagaagaaucaaccaaauauuugcuucuaacauccauaguguuaaggauauugugcucucugguggagagaauuucugguuauguccgucaucggcccacuuuacuaaccacaguugaauuucuggagcuuguuggauuugccauugccagcacaacuauguugguggagaagucucugagugucauuuugcuuguuguagcucuggcuaugcugauuauugaucugagaaugaaaucuuucuuagcuauuccaaacuuaguuauuuuugcaguuuuguuauuuuuuuccucauuggaaacucccaaaaauccgauugcuuuugcguguuuuuuuauuugccugauaacugauccuuuccuugacauuuauuuuaguggacuuucaguaacugaaagauggaaacccuuuuuguaccguggaagaauuugcagaagacuuucagucguuuuugcuggaaugauugagcuuacauuuuuuauucuuuccgcauucaaacuuagagacacucaccucugguauuuuguaauaccuggcuuuuccauuuuuggaauuuucuggaugauuugucauauuauuuuucuuuuaacucuuuggggauuccauaccaaauuaaaugacugccauaaaguauauuuuacucacaggacagauuacaauagccuugauagaaucauggcauccaaagggaugcgccauuuuugcuugauuucagagcaguugguguucuuuagucuucuugcaacagcgauuuugggagcaguuuccuggcagguaagcuuauuguuuguccagcaaccccaaugacguguaauaaaaugcuagcuucaauaauugaaauuaaaguuauaaggucaaguuccugauuucaaaaggauauucauguuugcucuuaauuuuguucauggaauugaagcacugaauguguuucaagaggauaauuuauuugaucucuagcaaagagguaccaaaauguuaugaacacucagcguugagaugccucccgcuuccugacuguucauuagugaaacacucaucgauuaaagagucuuagaauacuaacauuuggaaaguauuuaaagauuguauuuugauccuuuaauuauacccaugaggaaacugaaagccaaagaagacacauccagagucacuaguacuagcaggaacaagguuacuuaacuucugucuauucccuggacuccucacuguaacauguuucuuuuaugcagccauuucucugaagguuuuauauaaaaggugaucagauauauaacaacauagcagguucuuaauuauagauuagagguuauccuaagaaagaaaacauggguuucacaguaccuuugcugcccagaaauguuuucuaaaagguucuuguagacaaagacauuuguacaguuggaguuugcaucugcaguauuaacaaacccagucuuccauuaauugagcauguauugacuaugcacuauaugccaggcacuauagugggugcggaagaucucaggaugucugucaaagguggcacagucuccaaugggaggaggaagaggcuggcauguaaacaaacaauuaugauuacagugugauaaauacuauaaucuguguacaucagacugggauguggggcauaaaggaaagucagcucugcuuggugcagcucucuguaagaguuuguugcugcugacugauuucuagaggaaagucagcucugcuuggugcagcucucugcuuuguaacaguuuguugcugcugagugauuucuagaaguguguuuugaagagggagaugugaagacuugccuggacauggugcuagauuucuagucagcugggcuagggcagggauccugugugggagucagccaaaugaggaaaacaucuuggguguggccugaggauauuguccuuacuuugcucuacuugcugguguuagguacugucagaauuauguuguugaugucaaaaacucaagcaugaguuuuccucccucuuccuugccccuccuccugcuagcuccuuucccagcccuaaauacuuuuucuuuuccaagucagccucauucaugcuggaugccauuccaggcuuucaaauucuguuaaccaaauaugaauauuuucuuggucuccaaacuuuuucuuaccuaguggucuucagauaugguguguaccacuggagguacacaaaaacuuuccaaggagucugucagcagagauaauuuuaagagaaucaguuuccugauucucaccuuccauucuacucuuuccuaaaguugaucuacuugagaaucccuuuagcuguaggugauagcauugugguuuuaauuuaugucucuaaugacuaaugauguugagcaucuuuuuauguguguauuagccauuuacuuuguuguuuaaauauucacaucuuuugcucauuuuaaagcugagguuauuugucuuuuaagaguuccuuauauauucuggauacgagcccuuugucagauaaaugauuuggaaauguuuacucccagucuguggcuucuguuuuuauuuucugaaugauacaaauuuuugaagaguuuucaagaguaaagguuuuuaauuuuacagaguccaguuuauccacuuuuucuuuuaugggcucugcuuuuaguaucuuaucuaagaauucuuugcucaacacuaggucacaguucuuucaaaagcauuauuguuuuaacuguuacauuuagguguaugauccauuuugaguauaguaugagauaaggaucuaaguuuguuuuuuuuuuuuuaauauauagaucucauuguucccagcaccauuuguugaaaagauuaacauuucgccuauugaauugccuuggcgucuuuguuuaaaaucaguuaaacauaaacguaagguuguauuuuugaguuuuuuuguuauauugaccuauaugucuaccauugugcuagcacuaugccaucuggugagauguuuucuaauuuccuuugaaauuuccucuuugacucauggguuauuuauaaguuuguugugugauauccuaauauuuggaaguuucucacauuucuuuccauugauuucuaauuccauguaguuggagaacacugugugauuuuagucuuuuaggccacuuguuuuguggcauggcauguuuuauuccauguucacuugaaaauaaugaguccucuguuguuggguacaguguacuauaaauaucagcuagauuaaguugguugguggugguguucauguaucuauagccuuguuaauuuucugucuaauucuguaauacugagagagaugaaaaucucuauuauaguuccugaauugucuacuugcuuuuucaauucugucuuuuuuuuuuuuugcuucuuuauuuugaagcacuguuccuagagguaaaugcauguuuguuauaucuucuuaccauauuaacucuuguaauuaugguaaacagcauaguugaguaguuaaaacagagauuguauggccugcaaaacaaaauauuaacuaucugugcccccguuuuuuuuuuuuuuuuuuuuuugauacggaucauguauuugugugaccaccacuaccacagucaauuuguagagcaguuaaaucacugccaaaauucccucuugcuuccuuguagucaguccuucucccaaccccagguacuuggcaaccuguuuuccguuccuagacauuuuccuuuuccagaaugucauauucguaaaaucauuuaacauuguagucuuuugagccugacuuuuguuuuugagacagggucuugcucugcagugugggcuagaguacaaugguacaaucauggcucacugcagccucgaccuccugcgcucaagcaguccucccugccuuggccuuccaaagugcugggauuauaggugugagccacugcaccuggcccugagucugacuucuuauuuaaaucauuugagauucaucuguguugcugugugccaucaguaaguuaguuacuuuuauugugagcaauaucccauuguauggauguuccaguuuaucccuuacucaguugagagacacugaaauuauuugcaguuuuuugguaauuaugaauaaagcugcuauaaaccuuuguagacaaggguuuguguuaacauaagcuuuuauuuuagugugaugugggauugcugggucauguggaaagcauuucuuuuaacuuuauacugccauacauauguauuucuaaucuacagaauaagcucaugacauaaauuaucucuguauauauuccagaaaucaagacucaaaagguuaauuaacuuauucguguacacauagcaaguggcugagcugggauugaacaaaagucuaacuccgaagcuuggguccuuuccacuaugcccuacuucuuccacguaaagaagucauuugacuuuaaaauuauacaguagccuucauaauguucuuaaauuuccugaaacaagcaaaguuuugaaagucgccugugguuucuuaaagcuggauuucucacagucucuccauuuauauauugccgcauuuacguauacuguuucuuaguugggcuuuacuuucuuuagacuucuauguauguuuuccaaaucugguuugcauaaggugacucauacaagaaugcuucuaaacaaacaagccguauauguuuauguaaauguuacauuuuaaaaaugacauugcauaaagaaauuuuguuccuguuaucugaaaaauuuuaggauaugaaacauugaauacuuugaccaugacuugaaagcccagcugaauagagaucuaauaacuaguaacaacuuuuauucaaagggcauuacuuacagguuguuuauuggucuucuuuugugcucaguuuauaucugcucugaaauaugagccaugucuuaaaauuugauaaugagcugaggauaauuuggagaagcaaaggagaauaaguacuuguaggcuugaaucaauugaucuuauuuguuacuuggaauuaagguguaaggaguacuccaaagucacaaaugacuucuagauugaagcuauagaauaaagguuugcaggccaauaaaauugaagcucucugaaaguggcaagcagacaaaacauccuaaauuuauuuuggcuuccccuggacauacuugccaucuguucaguuaagauuacgaauuuuuguauugccaaaauacuaacuugugugugaucauaauagaauauuuaauacuguuuuucuaagcuugcuuuuucaaaauaaccuaauagaaguacuuaaugauuuuuuccugauaaauuugcuuucuaaaaauguaugacagggccaggcaugaugacucacauuuguaauuccagcaguuugggaggccaaggcaggaggauugcuugaacccaggaguuugagaccagccugggcaacauagggagaccuugucucuacaaaaauaaaaaaauuagccaggcaugguggugcaugugccuguggucccaagcuacuuggguggcugaggugguaggaucacaugagccugagaggucaaggcugcagugaaucgugaucaugccgcugcacuccagccuggacgacggagugagacccugucaaucagcauaaaauucucaguuucuaagauuuuuuaauauaaaaagcaaguaguaacagaucaucuguuauuuaugaguugugaucaauagaccccuaaauaucuacuuauuuagucuacuguaucaaauaucaucaucaauguugcaaaaccaacauuaggguauugaauaacaucacuaucaauuaacauuuuaauuggaauuuugaauuauuaggcuuuucauuuaagucaucuacaaauugauugacaauugaacuuuaucauuugcuuaguucacugcuaaaucaaacuguuuaauacuuuuuucuaauaguaaaaacauacugaagauugagaagcacugguuuagaaaaaauauguaaauauauaaaauguaauagccuggaaaucaaucagaaaauuggaacugauuccauuuguaagaacagaaacauaaaauaaguuuuaaacuuauaaaacuuuuauuuuaaaauuacuacaaaccucaauguagguuauaaaagaagacuucaauaaauggaaaaacacaccauacuuccugggaugaaaagacucaaugcggugccuugcaggcauuuguauacauagaggaaacuguuuucaaagcugagcugcacuuuugguccccucaagaguggcaaaaauaaaagccaagcccagggccuccagaagugagaucucugguaaauuaccucccauuuuacgcuuacacacugaaagaagaggguggagccauguguguuauagcccucucaugaacuugcuuucugcccuuguguccuguuggugguucaaccugggauuaaguggucaaaccugaauuaagauauguagacucguaauguccgcagcucucuggaagaaacagauugccucuaggagaagguaucauuauccuaggccuaaaguuaauaauaauauaauuuuuauauccaguguucagcuuauaaauuuaaccagguacacacacacacacacacacacacacacacacacacacacacacacacacacacacagcaccaagagcaagaagcagcaaaaccaacagacaacagaaaaaaaucuuuagguauuggaauuaucaaacagaaaaccaucaugcuaaguugcaaaaguaaaaggagagaucaggacauaaugguaguacacuggaaacuuuaaaaaaugacaaggcagauuuuacaaagaacuaaauagaaauuuagaucaggaaauaaauuauuucaguguugcaaacauaacauuagacaaagcugaagugggcauuagugaacuggaagauacaguucagaagaagcuauauaagcagcagcaugaaagagcaguauggaaaauacugaacagaaggaaaggauaagacucagaggauaugguaagaagaucucauauuuuauaagagucucaaaaauagagggaagaaaugaaggccaaaggaaauaugugaaagaauaaaaaauagaacaacagaacagaagaagagagaccaaaaacagguccaugaauacuuaugacaaaaguggcacuguaauguggagugguugauauuuucaguaauuugugcuugaacaauugaguguuucuguagaagaaaaaauuggaccauuaucauaaaaucaguuauauuuggauuauaguuuuaaauguaaaggcaaaacaauaaagccuuuagaggauaauguuaaaauaucuucuuaaugguuggauagagggauuuuuuuuaacaaggcauaaagugacuauauuauaauuaagaacucauguuaagcaaaaaacagcauuaagguagucacagagucaccaacaaaagacuuucauugaaacuauguucagaaccaaacaaaacuaaaucagugaagaaaaggucaaccccauagaaaggugggcaaaauauuuaacacuucaucaaagaugauacccacauagugaaagguacuuaaccucauuaauaaucagaacuugauauuuauucuaguuuugguguaauggcaaacuguaagcaauuuaaauaccaauaaugggauccacuaauuaaaguuuuauauguaucauaggaaugccauuuggucuuuacaagugauuuagaguaauguaagcuuaaauuaaaauguugauagauuauguaucccauuuugguaaaaaaaaaaaacauacacaugaauauguauuugugaaaaauacauugcaugaagucugggaauauuucagaguagcugugcguauagaugaugguauuuggaaugauuuuaaucacauaucuuuuuuacuuauuuguauuuucuaguguuuuuaaauggagcauguacuguguuauuuaugucauugacaaaauaggauguaccaaaauagggcaguauauucauuuuucuauugcaggaauuaauuuuuuuauuaaauuuugaucaagugaaccaccccuuaguguuaaaaguauguguucaugcaccuaggcauauaguaugugcaguagcaauaccggaagaauguaauaguuuaauauucuaaagaaauguucaagugacuauccauuuucuuuucacuuaaaugagucuuaauuuuuucugcuuuuucauugcaguuaauaccugauugccuccuccuuauuucuucugccugucuacuuuccauucugcuuuuacaaugcuuauauguccuuaauauuuucuucuguuaaauuuugauugcacaucuagagaguucagugcuuuauaagguaaacuauaucauauaaacggaauucguuuuuauagcuuuagggucuuaaauuuccuuaagaacuuauacagaaagaaaguaauagagaaagaauacagaaagcauauagaaaaaaguaauaguuuaauauucuaaagguauguucaagugacuauccauuuucuuuucacuuaaaugaguauuuuuucugcuuuuucauugcaauuaauaccugauugccuccugcuuauuucuucugccugucuacuuuccauucugcuuuuacaaugcuuacguguccucaauauuuucuucuguuaaaauuuugaauuugcacaucuagagaguucagugcuuuauaagguaaacuauaccauauaaacggaauuaguuuuuauggcuuuagggucuuaaauuuccuuaagaauuuacuuucauaauuucauggggaaaaaaugaccccuuucuaaagcacucuuuuugauaaaguaaauaaaucuguuauuugaaaaaugacauaggcauguggguuuuaacaagauauuuguuuucuggcauuuucucuguuauaucaaagagugguuuugguuuguuuuguuuuuuuuuuuuuucucgucuggauaggauguuauuugacaauucuuuuuuaaaaaugaugugccguguuuugccacaacuuccaaaaaacuaagagauaaauuuaggauuuauugcacuaguuagcucauccauguauacgugucugcuuuaacugaaaauuguuuuuagaucauuaauuguuccuuuuauccuuuuugaaaguagaagcuaaaaaaugugaaucaaugugcaugcauguaaauauauacacauauguacauguacuauguaaacauguuuuggauuucuuuuagccaacaaauggaauuuucuugagcauguuucuaaucguuuugccauuggaauccauggcucaugggcucuuccaugaauuggguaacuguuuaggaggaacaucuguuggauaugcuauugugauucccaccaacuucugcagguacaguaaucuaguauaguuagugauaacuauucacuucauaacauuuucuuaauauuuauaugaauaaaauauagcuccuuuucaaaacuguuuucaaaauauaacuugugcauuucuuccaaauuuuuaacaaacuuuauuccaagugauaauaucuucagaguuaaauugaaauauuuugauaaauaugauaagcuuauauuuuagcuagaaaccagaaaauauucaugaauaacuuuucuaaggaaagaucuuacccuaaagggaauauuuuguuaagaaaguguccucuggcuggucgugguggcucacaccuguaaucccagcacuuuaggaggccgaggcgggcggaucaccugaggucaggaguucgagaccagccuggccaacauggugaaaccccaucucuacugaaaauacaaaaauuagccaggugugguggcagguaccugcaaucccagcuacucaggaggcugaggcaggagagucacuugaaccugggaggcggagguugcagugagcugagauagggccauugcucuccagccugggggauaagagcaagacuucgucucaaaaaaaaaaaaggaaaaaagcaaaagaaaguguccucugaagcaacauagugaaauauaguaaaacgugcucugggccugagaggcuggaggucuaguucuuuguuaccuuugguacacuauaacuacucugaaccuuauuaucugucuuugccuaaaauguauauagugauaacucuucuguucaucugacaggaaugguaugaagcacuaaaaaaaaaaaaaaaaaaaaaaaaaauguaaaaacacucugcacacugaaaaaugccauacaaauacuaggaauucagaggauuggcagugaaguuuaauaaauguuuauugcaguuuuauuccaaaauaacuuuuacccacaaagguggugacaucuguauaaaucuguaaauguugcuacauuuugauuuuuauuuuauagcuaacuaccuuuaaaauaauucuuugccauaaaugaauucugaugacaguuuucaucacacuuucccugggggagaggagaguggaaguaaaguuuuuucccaauuucaaguauuugacauaaaaaucuccaaauagacuauuuguaggaaauauuuuccuucguuaaagacuuaauacaaaguugaagguuuaagaacugaaggaaacagauuuggaaaugucacauaaagugagaaaugacaaccuuguagaaagaauguguggaaauaguaauaugcacaguuagauauuuauuccauuguaauuuuuuuaauguauuccuuacucuuuugugacuguaaugaaaaaaaguuaguagaauaguacugaugauauaugaagcaaaaucuaacguuuucaaaaaucccgauagaaaucccuuuucuggauaggaaugaugauuuuuucuuucucaauauuaaugguauuuugcuaguuauaagacuugcuuuaucaucuuuguacuagaguaccauuuuauauuuguucuaggaguaaaucuaagucuucaacuaguguccagugguauaaagcaauggaccuaaauuuuaauaacuuuuuaaaugccuauuaauagauaauuucuucuauuauuuauguaccuuaaguuaauaaaauuugaacacaauuuuauugacuauuuuucaauacagaaguaaauauauaauuaaaauauugcuuuuuuauuuuguguuauaauauuuuuaaagaaguuuuuuuaauaguccccacccagauguucuugaaacaguguaauccugcuuuuaaaaaaccuuguccaauauuugucauguaagaaaauacgaauaaggaacaaagaguaauacuaucuacauuuggagacauuaucccagcuuuuaauuugauuauuguuuuaaugauaguaaauauaauauuuagaaaccagguuuugauuuucuaagcuuaauucucaguacuauaggaauuuuagaaagggugauuuuuuacaaaaauccugccacuuagcagcaacuauauuauaacugauucuuagauaaucaguuacaaaugacagaugagaaugugauauagaaugaguacuucuuguuuuuucuccuacuucaguccugauggucagccaacacugcuucccccagaacauguacaggaguuaaauuugaggucuacuggcaugcucaaugcuauccaaagauuuuuugcauaucauaugauugagaccuauggaugugacuauuccacaaguggacugucauuugauacucugcauuccaaacuaaaagcuuuccucgaacuucggacaguggauggacccagacaugauacguauauuuuguauuacagugggcacacccaugguacaggagagugggcucuagcagguaaacucaccuuuggcaguuucacuauuguaaagauacacauguauauguagaaaucuguacuucacacacagucguuaaauuuccaggauucuuaguuuacugaacuaugcauaugacucuaauuuguuuuucuuugcucuagcauaccuguuuagccuaauuuaaucucuaaugauaagauugggaauuacgucuuauagugauuagaaggaaaaaaaugcuuugagacuuacaguuucccuuaaaauauuuucagaauugcuaaacauauuuuucagaagcugauaaacuccuuugacuaguaucuuuaaguuuuuaaauguuauggaugcagauuucaguaguccuucacaucuguaguuuuauuuauguuauaaagcucaccaaaauuuuaaacagcagaucauguaguauggugggaguagcacuuaggucaggagaccuugguucugguccuaauuugccacagcuguguuauuuuaggcaaguuaguuaacuucuguuggcuucaauuuucucaucuguaaaauaaggggguaauuguaaaugaccauugaguuuuauucuaagguacaaaauucuguagggauuuuuuugcauuugaaaaaacauaaaauaacuuugguuugcaugcauuaugggaaauagaaaacuucuuaguuauugccaagagagaaaugagaucucuuuauaucauauauaaauuugucagucuuuccaacuauuaauagagagaaagucaagggcuuuguuuuaucaacuguuacuuguuuaggaccuauaacagagcccaauacauaguagaggauccuuaaguagcugauagauagaugaaaucauugaauaaaucauuaaaaaagguaauuuucuuauuuuagauuagaaauaguuauuuuagauuuaauuacaugauuuuuuuuuccauaaaaguguagauguuuuaaaccaagaauauauaaauaauaaaauagucauaaauaaaguggaaacauucaggauaaagaaaaagauaaauagaaguaguauggaaggacagaggcagaguugccaauauaagaacuccagaaagagacaaacaaaaagguuaagguagagaugauuuuaaacuagcaugaucucauugauuucaugccagauuuguaacugagguuuuuaucauaaggagaaauauuuuuuugaaauuuuucuuuuuugcaaauaaauauugaauaacucaguggccuucuaguagaaagacaagcuaauauuuauuggguacauuuuaagcaucagcuuacuguacuuaguaccuuacacacauuguuaaucuuuaugugaaauccuuugagauagauaccaucacuucuguuaucuucauuuuucaaacgaugaaauggaaauugaaaguuguuauguaacuuaucuguggucauaccacuaugugauagaaccaugauuuaagaccagaucugccugauuccuaaaguguauuuuuccccccacucuaccauguugccuccaagggugaaagccaugaugauaaaggaauggcauguucugguuaaguggauauuuuuguuaacaugggucacccauuucaaaacauuagaauguacaagacuaaaagaugcacugaacauuaaaacuaauugaauauaguuuauaaaaucauuuacuugaccuauaacuuuuuaauuacaacguagaaagcaucuuuuuaaccuuuauggcuacuucaguuucagguaaaguauaacguucuguguauuccaacucagagcacaagagaaagcuuuuagucaauuaaaauagccuuuacagaaauagaauuuuagaucuaaaagcagagauugcugaaacuuacuauaauccuuaugauaauaaacucuacccagaucaaauggaaaaaacagggcuaauuuuugguggccaugcauauaucccuaguuauuuuaaaguguuagaguaauuuuagaaguaagcuuuuuauguguguuuauaugaaggauuuauuacuuaauagaaacacuuuucaaaaaguuugcauuuuucuuaaguaauuuaaaauucauuaaguauuucuuaaagauagcuauggaaaucaauucuagauguucauuuacuaauacuuauaucagcuuuuuauuuuucuaagaaaaguaaaaacacuaagauaaacacacacacacauauauauaucucucgcaguuuuucuaaauuuucauucacuguuaggaauaauuuuugaagacuuuaagaacacuaaaauagaguuguauuuuagguaaauguuuagcaguuacauucuagaaugaugucuuuauaauuuuuuugaaguaugcuaccaguaaauugaccguuacagaauuccucuguuagcuaagauuuguucuuguguaacuuugaggcuuauuauaagaaguuuaaaaaaaagagagagaaagcauacugaucucccuucccugagaaagguagauuuuaucuuauaauucagcaacugcauacugucaugcauggccugaggcaucucgcauacuuguggguagucagguugaaccaggcccagaaaagcccgcuuuucaguuaguucaugcccuggccugcuuuagacguaguccucaagggcugauucugccucacaaauaguauugaauaucucugcucugaggaaaauacuuucaucuauuccaaauuaagugacaaagagcuuuaagcucugcuaauuuauuaauaguuggggauuuuuuguuuuguuuuuuguuguuuuuucagcaaacuuugaaauaggaaacaucacaacuggauuuuacuuggguuagcaaguugauagcaggcccaguauuaauaucgcugugggaaagagaaucuauauuugcccuuuaucccauaccuucacucacaguaguuagaauauguagucuucuuauauuuauggaguuucaugauauggaaccuaauauuuuugccucugcuugaggauagaaaacaauuaugguaauuacaggagagacagaaauaaauggaaaaaauguagauaauuuauaaagcaguuuauuacaaauaaaaccuuuaaaaagcagucucaauuacuuaaaaugcaucagauggauauuagcuuagauaaauguaaguacuuugaaucugggccaaaagccaaauguagcauagaaccuauucauaggagaaagcagagcaaaacaagagaaauuguuuagaaagcuuuaaugcugcuuuaggucucguugauaucuaaagagcauuuauauaagagaauuaggguagaauaugcucaagaauguuuauugaaauaguuguggauggcauguugggcaaugauguuuuguggcagauggaauuuacauaauaguucuuguaaucugugucaucuucugaucucuagagaaauuuaauagagcugacaauaauggagaguuaacauuuggccauuuuugaaaaaguaucuuuuggagguaucaguggaauaacacauuaguaauauguggagacaauguacugaaauagugucucugagauaauaugugugaguguuagagcgauuaauaaaaaaaguuuauuuucagguucuuaagcuuacugauuaauaaaacauuaauaaaugacacauaaagaauaugauagaaucccaauucuaaaggauucucucucuggugguguccauuuuuaauggugaaaccaagaggacaguugauuuggggaaaauguugggucuugugcugguaaauuguaaaaguaacuuaugcucaauguaaaacugucagaaaaauauuuuaaaaaccacauggaagugaaacacccagcaauagcugcuguuauaauuuuuguagauguacugucaugcuuuuucuaauauagacauuuucucaucaauaaauuuucuuuauaaauauuuuguuauaagauuuccuccuaagguuuuaggccauaguucauuuccauuucccaaaugggaaggucgucuuuuuuuguaauuuuuugucccuaugucuguucuuuccuuaagauagauucguagaauuggaaugaucguuaucaguguaccauugagacagggccagaugaggugaggguggcaguugccucaggcacaaaacauaagggaaugccaaaaaacucaauaaucaaaaugaauauuuuaauguaguauacuuaaaaaucaaaauuaaugcaaaaaaauaacgagauguaaaaccuguagucagaaguuuauuuacuuuagaacuuucuggguauauauauuuuuuuaaucccuuguucuucagcuauaaaacugauuuaaauguaaaucuguucuuaaacucauucuuguacagguaggaacaggguuuauuuucauucaauagguaccuacauaugaggaagagaaggaaacaaugauacagaauggggaggcaaacuuuuucuguaaagggccagauauuuuuggcuuuguggguuuagaugccuguugcagcuauucagcucugcuacuuuagagcaauagcagccauagacgguauaaaugaaugaauguaguuguguuccaauaaacuuauuuaugaaaauaauuauaugaaacaaauugcauacaguuuuuacuaucacaaaauauucugauuuucuuucaaccaugugaaaauauaaaaucaauucuuagcuuucaggccauacaaaaagagguggcaggcuggaucuggcccaugaguuguaguugcugccccugguguagaauguuagcuuuucuguauaguuguuuucacuaaauacaacuguguaaaacuauuuccuuaauuuuauacuagcagauuccuuuuuaugugaguaauaaggauuuuuuuuaccucaaguugaaaaucuguuguaaaaaauaucuuuucaaaagauacuuugaaagugucauuuaaauacuuuauuuuuuugcuuauuuaauucuaagaacuuaaggaaaauacauguauaacaagaguauuuucucucuagaagaaaaugauuaagaggguuuucuuaaugagaggcugcagaaauuauugcuccauugaauuuucucuuguucacagguggagauacacuacgccuugacacacuuauagaaugguggagagaaaagaaugguuccuuuuguucccggcuuauuaucguauuagacagcgaaaauucaaccccuugggugaaagaagugaggaaaauuaaugaccaguauauugcagugcaaggagcagaguugauaaaaacaguagauauugaagaagcugacccgccacagcuaggugacuuuacaaaagacuggguagaauauaacugcaacuccaguaauaacaucugcuggacugaaaagggacgcacagugaaagcaguauauggugugucaaaacgguggagugacuacacucugcauuugccaacgggaagcgauguggccaagcacuggauguuacacuuuccucguauuacauauccccuagugcauuuggcaaauugguuaugcggucugaaccuuuuuuggaucugcaaaacuuguuuuaggugcuugaaaagauuaaaaaugaguugguuucuuccuacugugcuggacacaggacaaggcuucaaacuugucaaaucuuaauuuggaccccaaagcgggauauuaauaagcacucauacuaccaauuaucacuaacuugccauuuuuuguaugcuguauuuuuauuuguggaaaauaccuugcuacuucuguagcugcucucacuuugucuuuucuuaaguaauuaugguauauauaaggcguugggaaaaaacauuuuauaaugaaaguauguagggagucaaaugcuuacuguaaaugcauaagagacguuaaaaauaacacugcacuuucaggaauguuugcuuaugguccugauuagaaagaaacaguugucuaugcucugcaauggucaaugaugaauuacuaaugccuuauuuucuaggcauauaauaauaguuuagagaauguagaccagauaaauuuguuuacuguuuuaagaaaacuaccaguuuacuuacagaagauucuuuuuuccaaacaguagguuucauccaagaccauuugaagaacugcaaacucuuucucuuagaaaagaaagagggcagccuaaaauaaacgcaaaauuugcuuauacuccaucacauucagaugucuugguugugacuuauuaccaguguggcagagaacccaaguuacauuuuagaucaaaauauucuuuauguagguauuguuaaaaggcuagagccuacaaguugcucuuccaugcguuggucagggggcccugaaaacacugguaauauuaagagucuuucucaggguaacuuaauguuuucuuaaugaacaguguuuccagcuacaaauucuuccaauaaauugucuuccuuuuugaaaaguacucucauagaagaaauuuagcaauuucucguugacugacucagucuauuuuaaguauucagaaaagauuuugauccccauugaguuaaugcucugccuugaaaauuauuuuucugauccuuguuagugauaacauuuuuuuucuacugaaggucagaggauaggaaacaaguauuucucuucugguauacauguaauguauucuguaaaaaaguauucauauuggcaauuuuaguuaggcauaauauugugguuguaauuuuuaaaacuuaguguuuugucugauuaaagcaggcacugaucaggguaucuccuaagagguaauucacuucuuauuccuuuccaauaauuauuacauucuaaauuuucaucuaugagaaauaacaaacaagaagggaauagaauuaaauugggguauaaucuaaucuucauuguuuaaaugguuugccuucucaccauugaagccauuuuuuuauagccucagaaagaggaaauaaugccuccaccauuuucuaccuggugacuugaaaauugaacuuuuaaguuaggaagaaguuagagucagggaacuuguauaccacuaucuaugcagcauuguuauagucugauuauuucuguguuuugaauaugauuuuccuaaugcucuaaauaaaauuuuguuaaaaauuaa

SEQ ID NO: 191585 - RNA, 120731 nt, Homo sapiens
uacuagaaaauuuaaaauuuuuaauaaaugugcuuuguucacaaaaugugaaaaaauacaacaaacacacacguacauuuucagguaugcuaccucccaccacuuggcaacuaugguaaaaccacaugaucuagucaugauacugaagaauccaaccaaaugauuaccauuuguuuuugaaacaaccaaauuauuuuggagaaccagcugugaaugugacaggaggccucauaacuucuuuauauccaaaaugaaauaauucuuaggaguacccauacaguauuagaaggcccuauuaacuuccacuuguuauuacauacaugaucuggcaucaagcugcaaugacugcuuauacuucaauacuuauacacugaauugguuuuuguggaauguguaucaguuuaaaucugugccaaccuaauuggaauaagcugaauuuacaguaacaaaugauauaaauucaaacaaauuuauacuaagugguaguagguuuuauaaagagacuuccucagaguacuacguaaaauacaucaugcacacuuuggagcauaagcagaaucaacaucuguaaacaaucagaauuuauagcaccaacauuuucgcuguaacacaaaggcugacuccagggucauacuauaccagccuuucaaaagcgcuguuuucauuuacuuucaaagcauuuucauuugguguauuguuuucuuugcucuuaagauauuuacccaaaucaaaaagcaaacaguaugguaaaagguacuaccaaaauaguucaaaagaguucuguauuauccuuaacauagugcuuuuuuuuccuuccccuucucuuggggaagcuacaagacauaauccuucagugcuuaacuggaaagaacagucaauccuaaauauuaaagaaucuuaugcuguugaaaguaaaugaaaaauuucgaguuauuuguggcauauuugagcaaccaauauuuauugcauuuaaucaacugacuuuaaaaaauuacaaucuuguuacuuucauuaauuuagcaugugaaauuuaauuagaaauacuggguacauacacucaaccauuuauaucauaaaggauaaguuuuauauuucuaaauaaaguuugacauucaaagguacuacggcaauucacaauaagcacaaaaacaucagcuuuaccagaguaaagaagugcaguuuaugaaauuuaggaucaacuauugaaaaugcaaguuuccuuuaaaaacauacaaacauacgcacaacauuaaccaugaaaucugaaacugugauauuucagugcaaaaaccucaguaugagguaauuuuaauguaauaaccacuugaaaaaaaaauccacacaguggcacucuuaaaaaugauagcuuccaugacaauugcuggcugacaagacaauguggacuaaauguucuuaacuguuuaaacuaaucuugucuuguuuggacauauauuuuucccuaaucauuugcuucugauucagaaacacagaaaggcauuuauuaauguggaaagggaaaauucccacagccaacuaauugauauauucaaagaaaauuuucugauaaaguuuagauagaaauuaagauaccaaaaggucaaaaccauuuuaugagaucaccaacagaggguuaauuuuagguuuuuccauauaauuugaaacuuguagugcggcaccuccuuaacggaaaggugaggacccuaucaaaguugguuucaacagaacauaaacucucuuccaagugcaaacccuuucaaaaagguguuuuaggucauuauugaguauuacauuguuccuugcuuaaauaaaacauuuuguaaaugaagccuaaguuuaagaaaaguaaaagugaacucucagguaaauauacuucacaccaaggcccaaaucaacaagaaaguuaugaaaauacuacuuuggcaaugguguuuauuggauagggcuaauaaaauuagaauacacacuuugggggacaucucucccccaaugucugaugcugucaaaugagcuuuuaauauaaggaagaaauaaaaagaauuaucaccaauuacaaaaaguucaguaaauauuggaucaucagacaaaaaaggaacauaaaaugacuuucuguaacaucacaauuuuaguuagaaaaaagaaaaagauaagugcaucacaaaacaacuaaccgaucuauuuuucuguaucacauuuaacuugugagucaucaaagugcaaucuacagcuuucuacaucuuaaaguuuuccauucaaugguuuauagucaacacugaaaaguugaaaaggaaaacauauagcaaauuaugcuuguuuucacaauagcacuaaagagaaaaagguaccuuucuaugauagugcuaaaugcuaaaguaacaguaguuucugcuaugacaugagucacucugcaugaaacuuuaagcuuucuauauaagaauaaauuuuaaaauugagaaguagaaaaaaauagcaaacucuguaaaccucugcauuucuuuuaugcaaaccagguuuucaguacugaguucauguuaguauuuccaauugguguaagcaauuaguuuaggagccuggacugaaaggggcuuuuugcuucuauauuaacuuaaaaguaauauggggucuucuagcucauagaaaggaauagagcuggcuugacuuucuccagaaucugagucauauggcgcaucagggaguucugugaaaccauaugcuaguuguucaucuucuauaucugaucgaacauagcaggaaggguuagaauauuccucaucuucuauacuguugaaaucuugaggaauauauaacauuccuggguaguuccuacuaaccaagucacuugugguuuuuagagagauuuuccuaaaugccaucagaugcauaugugaaaauuuugaguacuugaagcguuuaaagcccagggacucuauagcaaucuuccagcuuuucaucaucauagcaugacgguucugaugggaggaaucaggugugaugauuaguaauaaaccauuuaacacuaacaguucaugggcuuucuugcagcaaauccaucgcugguaaggagauggaaaauaagaaagaaggagagagaaaacaaccacauggaaaagcucuccaggaagagaaucaauaggguuuuucagcugcuucaaaaaagcaucuauagcauccugugcaagcuggagugguugcugaagcuguaaguucaggaaaucacauuuauagacacucugcagaaacagaaaacaaggcauauuaagaacuucaagauuauuuccacuuuaguacauagacuuuucagcaaaccauuucacauaucauaguaauuccagcauugauuauacauuuuuccuuuuaaauuauuaaacuugaacagauguauucaaccacaacuuuuacaaaaaucucaaaguaauuaaguccaaagaccugcuaaucaucauuuaaauauauguuuuuugccuaacaauuuaaaaugggaaauaauuuguguauuuuggguugggacuuacaugaauuuuaauuuggguaggaguuuacaggaaugacauuucuauuuacauucacuuuaacauuuacaguuaccaaaaacaaacuaauauaaaaaugcuaaacaagaaauaccaugaaauaaagaugaaucaaauaaagaggauaaugaaagaggcauuauaaaauuuguacaagcagaaugauuccaaaacuuuaguucuuugaaacuguuaacuuuaaccauuuaaaaaguaacccucaacauuacuuuuauucuauuaaaaaguuaaucccuaguuuggaacaaacuagauuuaguuagacaaaugaccaugggaaacaauacaacagaggaaugaauaacauuauauaauuugcuaaaucuuaaaacuauggaaaugaaucagaauaagcaauuuuaaaauuagacaaaaauaacucuaucauauaccaauaguuauuaacaaagauaugaccuaauaccuuaaucccucacucauguuaguguauauacaagccggccacauagucaucuggacuguuuauuaggaaaagugauaugcaauguucuaguaccugaaaaaaagaugcuuuucuucuucccuuuuucuuaaaggcagcuuuauugauguauaagugacaaaaagcauaagucugauaaguugugagguauuuuuacacucaugaaaccacuggcauggucgaauuaaugaacagauccaacaccccauaauuuuccuuauuccccuuuauagucccuuccuucucuuccccugccagcaggcaaccauugaaguuuguauuuccuagaauuuuauauaaauaaucauuuugagauuuuucuugcagguauuaauaguuuauuccuuuuuaaauugcagaaugguaucccauuguaucaaggauguaccacaguugguuuauccauauacaccuguuuauggauaucuggguuguuucuaguuuugguuauuacauuucaagcugcugugaguauucccauacauguguuugaaucaacauucuuuaauuugucuuggggaaauaucuuggguggcuagaucauacaguaggugguguaguagguuuaauuuuuaaauaacucccaacugauuucaaaagugguuauguaguuucauguucccaccaggaguaugugagaguuccaguuccuccaaauccuuaucaacucuugguauagcuagucuauuucauuuuaguaauuguaauagauguguagugguauuucaguuuuaaucugcauuuuccuaaugaguuagugacauuuaucaucuuuucccggacuuauuugccauccagauaucuucuauguuaaagugucuguucaaauauuuugcccauuuaaaaauaauuggguugcuuuaaauaaaguuuuaaguauuuucuuucuggguuuugagaguucuuuauucuugaugcaaguccuuuaugauauaugacuugaaaauauuuucucaguaucauguggcuuaucuuuucauucuuuuaacaguguccuuugaagagcugaaguuuuaaauuuugaugaagacuaauuuaucaauuuguucuuucuuagauguugcuuucaaagucaggucuaaaaagucuuuuccuaucccaaggucauaaagacuuuuuuucaaaauguuuuccuuuaguaguuuuauaguuuauggcuuuuucauuuaggucuaugauacauuuugaguuuuuuuuguuuguuuguuuuuuuguuuuuuugagauggagucucacucuguugcccagacuggagugcaguagcgugaucuuggcucaccgcaaccuccgccuccuggguucaagugauucuccugccucagacucuccugaguagcugggacuacaggcacgcaccaccaugccuggcuaauuuuuguauuuuuuguagagacaggguuucaccauauuggccaggcuggucucgaacugcugaucuugugauccgcccaccuuggccucccaaagugcugggauuacaggcaugauccaccacacccagccaaggucuuuuuuuuuauauggagugugguaugguuugaaguuucuucuuuuguauauggauaccccuuuguuucaacaccauuguggaaaagacuaugcuuuccaucuugggcaaaaaucacguacguaaguuugggcuuauuugugaaccaucuauuauauuucacugauauuccugaacaucaauaccaugcugucuugaauacuguagcuuuauaauuuugaaaucagguaguguuacucuccaacacuguccuucaaaguuguuuugagcuauuauucuagguccuuugaauuuccacacagauuuuagaguaaguuuuucaauuucuacaaaaaagcccacaagaguuuugaugaggacugcacugacucuauacagacagggucucacucugucaccuaggcuggaguacaguggugugaucuuagcucacugcaaccuccacccucugggcucaagcaaucuucccaccucaggcuccugaguagcugggaccacaggcgagugccaccacaucuggcuaauuuuucuauuuuuuuuuuuguagagacagguuuuugccacauugcccaggauggucucgaacuuuuggacuccaacaauccacuugccuaggccucccaaaaugcugcgguuacaggugugagccacugcacccaccuuaggucaucuuuacuuucuccuaauuugugguuugcagcauguggauuuuucuacuuuugucagauuuaugagcuacauauuucauauauacucacauauaaaauaaacauuucauauuuuugaugccagaguaugguacuguuuuuaguuaaaauuucugauugguugcugcuaguauauacacacaaauuucuguauauugaucuugucucuugcaaccuugcuaaacucauuuguuaguuuuaggagcuucuuugaagauuacacagaaaaaucaaauagaugaucgaugacaccugugaauacaguuuuacuucuuuccaaugugcaugcugcuuauugcuuuuucuugcuuuacugaauuguuagaaccucuaguacaaaugcuaaauagaagcuguaagaguaaacauccuuaucuuguuuuugugagaaaagcauuuuucuuucaccauuaaggaugauguuagcuggagauuuuucagauacccuuuaucagguucaagaaauucccuuaaauucugaguuuuuuuuuuuuuuuuaaaucaggaaaguccagauguugaauuuugucaaagcuuugucaaaugccuuuucugugccuacugaaaugaucaaaugacuuuuucuuuuugaguucauacgauagauuguuuuugaauuuuaaaccaagcuugcauuccugagauaaaccaaacuuggccauuauauauuauccuuuuaaaauaccuuguuggauucaauuugcugaaauuuuguauagaacaucuguaucuauauucauaagggauauggaucuguaguuuuguuuuauaacauuugucugauuuugauaccagaguaauggccucauagaaugaguugggaaguauuccauccauuucaauuuuauggaagagaauauauauaauugguauuauuucuucuguaaauauuugguaaauuuuaacaugcaggcguuagugccuggaauuuucuuugugggaagguuuuaaacugccaauucauaauuucuucaauagauuuagggccauucaucuuaucuguuucuucaugaauaagcuuuggugguuaugucuuucaaggaauugguccauuugaauugucgaauuuauuggcauaaaguuguucaaaauauuuucuuauacuuuuaauguugguaaaaucugucaugauguuaccuuuuucucuuuacuucugaucaguaggcuagaguuuauaaauuuuauucaucuacucaaagaacuagcuuuugcuuucauuaauuuucccuauuuuucugaaaguuuucuauuucauuugauuucugcucugaucauuauuuccuuuuggauuuacugcucuucuuuuuucuucuaguugaaaaguugaugucauugcuuugagacuguuaccuaauaaagguguuuagugcuauaauuuuccccuaaguacuacuuuugugacuuuagugacaucuaugcauuuugauaucuuguauuuuuauuucaaaaaaguucuaauuuccauugugaauucuucgccaaguguucaguauaccuguucuaggaauuauuuagaggggugcugaaaucucuauaauuuuaucaauguuuauguuuccuugacaguuuaucaguuuuugguuuacauauuuggaagcuuuguuauuaggugcauagaccaaguuugguuuaggauuguuauguacucuugaugaacugacccuuuaaucauuauggaaugucauuuuuaucccugaucauauucuuugcucugaaauauacuuugucuaauuuuaauguagccaugccagcuuucuuuucuccaucuuauugcuuucacucuauuugugucuuaauaauugaaguacauuucuuaugggcaacauauauuugggucuuggcuuuuuucccccaaucugccagucuuugccuuucaauuggggcauuuaggccauuucuauuuaauguguugauugaugugauuagguuuuaaaucuauaaucuugcuauuuauuuucuacuugucucacuugauuguuguucccuuccccucuuccuucaucuuuugaauuaacuaaauuuuuuaugauuuuauuagccuuguuggcugauuagguauaacucuuuuauuucagcaguugcuuuaacuuaucagucuaccuucaagugauauuacaccacuuaauguauaagaaccucaaaguacuaauauuaucacaguggacugguuccaggaaccacuguacauacccaaauccacguucaaguccuuuauauaaaaugguauauuugcauacacccuaugcauauccucccauauauuuuaagucaucucuagauuacuuauaauauguaaugcaauguaauguuauguaaauaguuguuaugcuauauuauuuuuauuguuguauuguuauuuuuauuuauugagacagggucucccucuguugcccaggcuggagugcaguggcacaaucuuggaucacugcagccucaaccuccagggcucaagcgauccucccaucugucuccugagcagcugggacuacaagugcaccaugcguggcuaacuuuuuuauuuuuuguagagauggggucuugcuguguugcauaggcuggucucaagcuccugggcucaagcaguccuucugcauuggccucccaaagugcugggauauuacagguguaagccaccaugcccugccgcaaauauuuuugaucugugguugacugcauccacagauguggaauccaaguauauggagggccaaguauauuucugauucucucaugucacccuuuaugcuacugucauaaauguucauuuuaucuauauuaaaaaccccacucuauaucauuauuuuugcuuaaguuguuguauuaguuugcuagugcuguuguaacaaaguaccaugaacuggguggcuuaaacaauauaaauuuucucauaguucuggaggcuuagaagucugaggucaagauugugggaagauuucuuccuuuugagggcugugagggagaaucuaaucaaugccucuugccuugccucuagugguuugcuggcaaucuuugguggucuuugguuuauagaugcaucucuccaaucucuguguucaucuucaugugacguucucccugugugcuuguuucugaguuaaaauuucuccuuuuuauaaguauaccagagucuuauuggacuaggggccacuguaaucaccccuguuuaauuugauuaccucuguaaagcuccuaucuucaaauaaagucacaucuuuagaguuagaacuccaacauaucuguuuuagguugacauaauucaacccgaaacaaugguaaauuaucuuuaaagaguuuaaacaacaagagaaaaucuuuuuagcuguauaguuaucacuucuaguauucuucauuccuuuguguagagccauauuucuaacuggcuaaagcacuuccaccuuaacauuucuuauaauacaagcuugcuaauauugaauuucagcuuuuacacaucugaagaaaaucgauuucaucuucauuuuugaaagacauuuuggcuggguauaaaauucuaggugacuuuuuccuucaguacuuuaaggugucuuuacaauuucugggagcuuuuaagauuuuaucacuaguuuuagaaguuugauuugauguuccuugguguaauuuucuugauguuucuuuuguuugggguuuguugggcuucuuugaauuugugaguuuaaagcuuuaauuaaauuggaaaguuuuuggccauuuuuucaaaucccccaccuuuugggggauuccaauuaugcuuauauuuaguugcuuagauuuguaucacugaugcucuucuauuuaaaaaauuuucuguuucauuuuggauagcugcuauuguuguaucuucaauuucccuuuccuucugcaacaucuaauaugcauuaauccuauccaguaugcaucuucacaucacacauuauaguaucugucuuuagaagauagauuuggguauuuuaaaauaucuuccuauuucuacuuagcuuuuuauacaguuuugauuuuuuuaaauaauaaaacuguauugaagcauaacacauauaaggaaagaauauaaacuguguaaaaguuuagcuuaaguaauuuucccaaacugguauuaucucuauuuuaaugucccuguuucugugucaguucaggguuggucauuguuggcugauuuaucuccucacuguggguccuauuuucuugcugcuuugcauggcuguaauuuuuuuuggaugcuagacauggugaauuuuaccuugguggguucuacauaacuauggauugcuauaaauauuccugaacuguguucugggauguaguuaagaaaccuggagacaaucugaaguuuuugggucuuacuuuuaagauuuguuacaugggacuagagcacuaguauuuagucuaaggcaaauuauucuccauuauugagguaagacccuucucuguguacucuauuaaaugucugugaaucuugaaugcuccaguauggcugaugggaacagguacaauauuaauacuucucugugugacugcuggccacuguaaucucuaagccuuuuggacaguaccuuaucuagucucauguaguuuucucauauacaugugugcugauuuguacucagcugaguauucaaaggggaccuuuugcaggccucuggaguuuucccucuauggcuuucuuauuuucaguagaccauucuagaaacucuagcugccucggucuccuaggacucucaacucccuaggacucuucacaacucacagaaucaccugaacucugcuuggguuucucccugugcuauauccuggaaacucucucaaggcaauauccuagaguaauuguagggcuugucucauuuguuuuccaucucucagagauuacuguccuucauuaccugaugugcagugucaaaauuauuucgaauauuuuguugcuucaaguggaagaggauaaagcuggucuaucuuaucccaucuuggcuggaagaguaagucccuuuacucuguuuuaaaauuaguuauaggauucugaacugugaaacucugauucuacuacuuaaguuauguauagccgucuuuugucuucccuggugacuauacaauucaguguuuauaaaccuauccauaaauagauuuaauauuaagcuuaaggaucagaucaaauggucauggugucucagcagucccugaagaacaucucucauguauaucuugaggaaggaagggaagauaauccaugcaugaagccacuugggcuuuaaaacuaguuccugauggcacagaacuucucugcagugguaagcuaagaacagugauuuuauaauagagaaaacgaaaguagaaauaacaguaaugguuuuaggacuugcuuguuccuugauguuauacagauuuaaucaugcucaucaaaaugauucauaaucaaaguuucauaugaaaguuaaaucuucaugcaggaauuuaccaguaguaacaacaaacauuuauuuagcaggcacuguauaagagcuacuaugcuugaugcuuuaaauacuuuuuuuuuuuuuucaagaaaacauuacaacaaccuaugaaauguggucuacuacuaaccccauuauacagaugagaaaacugaggaucagagacuagaaaauggugauggagagguucaaaccuaggcuggaaacaugauucuauucuuuuauuuaaaaaaguauuaaauauacuaggcacucuucuagguacugggaauacagcaauagagggaaaaaaaucccuaauaacuaauauauuaauacucuaauccauacuuuaaaaauaacauuaaaaugcauuuuguaacuauuuaaaugcauuuuguaaaaauuuuuaugucuagaguucuaucaagaguaaaaugguaaacauaaugaauuaauguuauucuggaaaaaagucuuuuucugauauaaauaaugugccuacuuuagaguuaucuaucuuuaaaaaaugccuuuaacacaaacucuuggcaucacaugauuaagguaaaagaaaguucaagguggcugggugcaguagcucaugccugcaaucccagcacuuugggagguugaggcagguggaucaccugaggucaggaguucgagaccagccugaccaacauggugaaacccugucucuaccaaaaauacaaaguuagcugggcguggugguacaugccuguaauccagcuauuuaggaggcugaggccggagaaucacuggaacccgggaggcauaaguugcagugagugaucaugccacugcacucaagccugggcaacaagagcaaaacuccaucuuaaaaaaaaguucaagcugauaaggugauccugcuucacugaauugaaaugauagugucauaauaacugacccauaggaaauguucucaaaagaaaggauaguaucuaucauuuauugaguucccauaauguaccaggccaaguguuaaguaguuucaucgacucaaguacaaacaagcuggauuuaauaaaguucuggcugaugccaaagcccuugccucuuucuacuauuccauaauggcucuacaacacuguauauuucagaaagagaugcauuaaaagaaaauaauaaaccaaauauaacaaaaugcaaaacccaaacacuacagcuauguggaauucuguaaucuacugaaguuucuuuuuuuuuuuuuuuuuuagacggagucucacugugucacccaggcuggagugcaguggcgcgaucucgacucacugccaccuccgccucccggguucaagcgauucuccugccucagccuccugaguagcugggauuaugggcgcuugccaccacgcccagcuacauuuuuuuuauuuuuuaguagagacgggguuucaccauguuggccaggcuggucucaaacuccugaccucaggugauccacccaucuuggccuccuaaaguguugggauuacaggagugauccaccaugcccaguugaaguuucuuaauugcaaugauuuugcucuaacauaguuuuagauuauggcuauuuagaugauaaagaaaauaaagacaauauuugguuaaaugcucaauuauucacaaaauguauuuaguuuugaaaucucuccucaauggguacacaggaaauacauuugcuauuuuagggaugcaaagacagugcuuuucuuuuguaaauauacauguaaaauauuaaaguccaaaaacaaaacuaugcauaccucuacagcagguacaauaucuaugccaacaguuagaaauucuucaaacuucagaaauggguuaaagcagcugccaacaucaaguaaucugauuuuuccugaggcuuguagcaaccuaaaaacagauauuuuauaagaacaaaaucaaauaugagaauguaagaaaucacauagauuaucaguucuuuaacuuuuuggucucaggacccuuuuacacauauaaaaauuacugacggccccaaugagcuuucauuucugugaguuauaucuauuaauaaugaucauauuugaaguuaagaugaacaagucuuaaaaauauucauuuauuagacuuaaaaaggauaguaaaaaaguacagccuuguuuuauauauauuuacuuauuuaauuuuuuaaaaauugagacaaggucuugcuguauugcccaggcuggucuugaacuccugagcucaagugauccuccagccucagcucccaaaguauugggauuagaggcgugagccacugagccuggcucccccacccccaacccccauuuuuaaaaaauauauuuuuucaagucucuaaugucuggcuuaauugaagaugaaugaauucuaauaucugcuuuugcauucaggcuguugcaacaucacaugcuauguagucucuggaaaacuccacucuacacucagagugagaguaaaaaacaaaugagaaucuguaacaauacguaauacuauacacacuacuagucauucuuacccuuauugggcuaugguuaaggaguucucgaaucagaaaggcuaagaccauaaacugacucugacccuuaacauguaauacggggauaauagugguauuuacccuuagacuuuuucccagaauuaauaagauaauacauuaauacuugacccuaugccuaguacaugguaagugcucaaaaagugguacauaucauugcucacuauuaccauguuuuauaaaaaauuuguauuucuuccacuaaugaucuucccuaguaaaagcagaauuugcuauaugcuaaauucuguaguauagauucuaguaaacugaguagcaaaacauuucugagagucuuaaaaaaauauacuucuuauaaauugaauuuucuuucucaaugaaguauccuaaaccauucaaguuacuucaacauuauggaacaaucaccaauaacuuaaucauaucauggauuagcuuaauaacugaucaauugucagcaauauacuaagccuauuucaaauuauuuggcuucgcuccuuaauuuuuuauuugcauaaaauauacacucagugagugaccauguaauuaccacucaggucaagacauaaugacugcauccuggaaacaugacccucccugaugacaucccccacaccuuuauuuuagguagucacuaucccuauuuuagucacuuauccuuauuuauucccuugauuuccuuuuauagucuuaaguaccuacgacugaaugucuacaguuuaguuuuacacuacauuuuguaacuugcugcuuucauuugcuguuguuuuugaguuguuugugcuucuauaauucacuuuuacugcuguacaguaguacacuuaagacuuuuauuagcauggcauuaagucuaaagaucacuuaaggagaauuaacaucuuuacaauauucaaucuucaaauucaugaacaugaauaguuauccauuuacuuaaaaaacugucaauaguuuugaucauuuucucuaaaaaguucccucacaucuuuuguuggaguuauauuccuugguauuuccuaguuuuugaugcuuuuauuaucuuuuuucccauggauacacuuuacuuuuuuuuuuuucaauuucauuuuuuauuguugguuacacagaugcaauugacuuggauacaauaguccccccuuaucugguguuucaccuuuugugguuucaguuacccgcaguuaaccauggucugaaaaugcucaacagaaaauuccagaaauaaaccaauucaugagauuuaaauugcgugacauucugaguagcaugguaaauucucacaccgucagacccaggacacgaaucacauccauuuguccaaaguauccacgcuuuuugcauuagucauuaacaggauaucuuaugauccugauaucuaacaauucacauaggcauggcuucaugaucuaggauuacugaaagcaggugauccuccuccuccugauguacggucagaaggucaacaguagccuaacgcuaagucacaauaccuaugugauucaccucacuccaucccauuguaugggcauuuuaucaucucacaucauaaggguaagugaaguaccauaagacacuuugagauaccauacucaaauacuuuaaaaauuaugugaguaaaugaaguacaauaagauacuuugagauaccauacucacguaauuuuuauagcauuuuguuauaauuguucuauuuuauuguuauucuucuugugccuaacuuauaaauuaaacuuuaucauggguauguauauauaaaaacauaguauguauaggauucaguaaugucugugguuuuaggccuccaugggggugucagcauguacucucugugaagaagggguggcuacuaugcauuauuuuuuuuagauccagcagcuuuacuaaauuuaucucgauuguuuaucuguauauuauuuuguguacuccagguacauaaguuccuaaucugugaaaaaugacauuuguguuucauccucuccuaucacccaccuacccauccauuuuuuaccuccuuaccacucugcugaggacuuccaauauguugguagauagaagugggcaaguggauggacacuauuaaucuuacaucagaaggaacauuccaguguuucaccauuaaauguaauaacugguauagguuuuagauacuacccuuaauaaaguugaaguucuuuuauaaacuuuuauuuuagguccagggguacauguacagguuacacagguaaacuacgugucucaggaguuugguguacugauuauuuugucacccagguaauaaagauaguucccaauagguaguuuuuuuuauucucucccuucucugucuccacccuuaaguaauccccaguguauguuguuucccucuuuggguccauguguucucaucacuuagcucccacuaacaagugagaacaugaaguaugugguuuucuguuccugaauuaguuugcuuaggauaaugaccuccagcuccauccauguugcuaaaaaggacaugauuucauucuuuuuuauggcugcauaguauucuaugguguauauguaccauguuuucuuuauccagucuacugcuguugggcauuuagguugauuccaugucuuugcuauugugaacugugccgugaugaacguaugugugcaugugucuuuauuguagaaugauuuauagucccuuggguguauacccaauaaugggggauugcugagucuagugguaauuuuguuuuaaguucuuugaggaauugcuacacugcuuuccacaauggcugaacucauuuacauucccaccagcacuguauuagcauuccccuuucucugcaaccuugccagcagcuguuauuuuuugacuuuuuaauaauagccauucugaugccugugagaugguaucucacugugguuuugauuugcauuucucuaacguuuagugauguugagcauuuuuucauaugcuuguuggacacguuugucuucuuuugagaagugucuguucauguccuuugccuacuuuuuaaugggguuguuuucuaccugcaaauuuguuuaaguuccuuauagaugcuggauauuggaccuuugucagaugcaugguuauauuuucucccauucuguagguugucuguuuauucuguugauaguuucuguugcugugcagaagcucuuuaguuuaaguaggucccacuugucaauguuuuuguuaaaauuacuuuuggcaucuuugucauaaucuuucccagguuuuauguccagaaugguauuuccuagguuaucuuccaagguuuuucuaguuuaacauuuaagucuuuuuaacugaucuugaguuuauuuuuguguaugguguaagaaagagguccaguuucaaucuucugcauauggcuaguuaucccagcaaauagcgaguccuguccccauugcuuuugucaacuuuaucgaagaucagaugguuguagguuuuauuucuggguucucuauucuguccauuggucugugugucuguuuugguaccaguaccaugcuguuuuguuuacuguagcccuauaguaucguuugaaguuggguaacaugugaugccuccagcuuuguuauuuuugcuuagaauugccuuggugauuugggcucuuuucugguuccauaugaauuuuaaacuaguuuuucuuaauucugugaagaaugucauugguaguuugaugaaaauagcacuggaucuguaaauugcuuugacaguauggccauuucaacaauaaugauucuuccuauccaugagcaugaaauguuuuccauuuguuugugucaucucugauucgagcauuguuuugcaauucuuguugcagagauuuuucaccucccugauuagcuguauucuagguauuuuauucuuuuuguggcaauuguggaugggguuguguucuugauuuggcucucagcuugaauguucuugauguauaggaaugcugcugauuuuuguacauuuauuuuguauccugaaacucugcugaaguugaucaucagaucugggagcuuuuagcagagacuaugggguuuucuagauauagaaucaugucaucugcaaacagagauaguuggacuucucugcuucuauuuguuccuuuuauuucucuugccugguugcucuggccaggacuucaggaaaucauuuuaugcuuagcuagggugguuuuuccuuuuuugacacaaauccauguggaauuuuaucaaaugcauucuauauauuugugcagauaugacuaaucuaugugguagaaaaaaauucauuaauuguauagugucaaaucaaucuugcauucuuuggaagguccuaauuugguuucuauauauuauucuuuucauaaucugaggauuuguuuuauaugucuguguguauauacaguaaauucuggcuacuuguggucauuugguucuauaaagugaccaugaauguugaauuagugaaugcuaaacaauggcucuuauggaaacuacaggauuaggucucuggucauaacauuuucaucaauacauaccuugaauuuauauguuucuguuuaaaagcacuguauuuaauacguauuguugaugcauuaacauugaacucguggccaacagcacuauaacucaugccugaaggaagcuuacauaacacauguauuuuucuucguuaaggcacaauacagcauucuugugcucaggaacacuagacuucaacaccauauguggggguuguuuuaaaagcaaagacaucaacaaaaagcacaaacaaaaaauguaacaccaaauaggcugugaaaaggguguuugugugagagagcggaaacaaggcauagcucaccuuguuggaccucaguugggagguuuauguguagaaugagucaaauuuuuugccacaaguauugauuguaggguuacaaguaaguaaguuuuaguaaguuagguaauucacagacagggaauuuacaaaugagaaucgacuguguguagguauuuucaggauuuuacaucuauguuuauaagugggcaaguuuguuaaucauguuguucaaauauugauagucuuacuuuuugaauguuuccucaaucuuccaccauuaagaaaacagaauaaucucugcaaauugauuuaaagguauuuuguuauuuucauauauguuuauuuuugcaaaaaagaaaucuagaaaggauaacccagaaacuaauaaaaccucagaagaucuggaacaagguggaugcuuuaaguaugagaugggaugucugaguauaccguucauuguaguuuugacuuuuggaaguuguuaauguuuuacauauucaaaaaauaaaaccacuauaaacuaaugaaucuaguuaaaugucaaauaacacagaaggaaaaccaauaauucaauaccauuugagcauacuauucuaaagacaauaaucuugauggguaauauucuaaggacaaaaaaaaagaacugcaaaaauauccugaauuuuaauguuuguuguugugguagugcugauauagucaucuugaaauuauuuugugugucuugaagagcugagcaaauagcaaauaaacuaaaguugcugagagauacaaacucagaaugagggaacggagggaaaaaacccugcagugauggauuagaauuagagguuucauaagaaaggaugucaaagcagugacaccacaguaacaaaaagcauaucuaauacucagaauuugguuucuaaauaccguucucucacuaaaaggaaccuguacuacuuagaggaacagcuuaugccaggguugaagcagagaaaguacaugguuaagccucgaugaucuuauuguacaagaaaguaaagcacugcucaaacacuaugacaagguaaaagaaacuacuuuaaaggcauuuccauuggccuaauuugggaugauuucaccaucauaagaaugaacuuuaacacaaugauuuaaaaucugagacuacagguacuuaaauaagaaagggggagaaaggaaagauguuuuuacaaaagaaugccaaccaauauauuugagcaagauagaaauuaaucaccauuuugcaaccacuguaauaaaaacaacuugauuuaggcaagaccacuaauggaugcuaaagccacuggugaaaacagaaacuucacuugguguuuauguauauaauucacuccacaaauuacagacuaaagguacuugggaggaaucuggcagacaucaccuuagucaaaagaucaaacaucacugaaaaucugagugaugcccugagaacccaauaucaccuauguagcaugcuuaccagaaacauuaauguaaucacagggaguuuucuguauuaaugcaguccaagagauauuuaacuagauacuauauguaaucuuugaugaauccuggaucaaacaaccaucaaaaauaaaucuccccaaaacaacuauagauuugucaauuuucauuauauauaugaaguguuaauaaauuucauuauuuauucaauauuuguuucauauaugcauacgauacuauuaggcacaaauuaaaaauuguuauauuuuccuacuaaaucacaccuuuuaucacaaaaaaugucuccuuuaucucuagcaaugauacucuaaagccucauguuuuggauaucucucauaagagcauaaauuggauuuuuauauucagagucugacaaucuauguuuuaauuggaauauuuugaucuguuauauuacuuuugcacuuucuaucugcucuaccuauucuauguuucuuuucucacacucuguacuuucuuuggaaucacacuggaaguuuuaacaacacccagagauucugauuuaauugagggguacgauggagucugggcauuaugauuuucaaaagcucccuaggugaauguaugguauagcuaaaguugagaacugguuuuagauuuuuccuuuuuaaaucuuaguaauuccauguuuuugauuuugcuaauuugaaaauuuuacauugccuuugucuucacccagaccauacaaaaccuugagaacacuuaaaauucuguuaaccacauaaauuagucauuuuguguauuucaauucuauuauuauuacugguguauaucuguuuagacuuuccauuugggaucacuuuuuuucugccugaaagauagcuuuagaauuucuuuuaagugagguuuggcuuucccauucucgccucuccuucugcaacuccaauaaagaugaaaguuauacuucauuuuuaacuucugucuuuaaccauuuuauuuuuuuuauuuuacauuuucuugucugugugaggcaagacaagauaauaauguuaucuggaugauaauguuuccuaguuugauaauuccucuucaauucauuccauauacugaguuuauuuuaaauaauuuuggcuuuccaaauggcuagucuuuaaaguuucuauuucccguagaaauuuucaagcaauucuuuucucuaaaauagcaucaucccugggaugcaaggcuggcucaacauacgcaaaucaauaaauguaauccaucacauuaacagaaccacaugauuauuucaauagaugcagaaaaggccuucgauaaaauucaacaccccuucaugcuaaaaacucucaauaaacuagguauugguggaacauaucucaaaaucauaagagcuauuuaugacaaacccacagccaauaucauacugaauaggcaaaaacuggaagcauucccucugaaaacuggcacaugacaaggaugcccccucucacgacuccuauucaacaaaguacuggaaguucuggccaaggcaauccggcaagagaaagaaauaaaggguauucaaauaggaaaagaggaagcuaaauugucucuuugcagaugacaugauuguauauuuagaaaaccccaucgucucagaccaaaaucuccuuaagcugauaagcaacuucagcaaacucucaggauacaaaaucaaugggcaaaaaucacaagcauucguauacaccaauaauagacaaacagaaagccaaaucaugagugaacucccauucacaauugcuacaaagaaaauaaaauaccuagcaauacaacuuacaagggaugugaaggaccucuucaaggagaacuacaaaccacugcucaaggaaauaagaggacacaaacaaauggaaaaacauucuauccuaauggauaggaagaaucaauuucaugaaaauggccauacugcccaaauuuauagauuuaaugcuauccccaucaagcuacuauugacuuucuucacagaauuagaaaaaaacuacuuuaaauuucauauggaaccaaaaaaggagcccguauagccaagacaauccuaaacaaaaagaacaaagcuggaggcaucacacuaccugacuucaaacuauacuagaaggcuacaguaaccaaaacagcaugguagugguaccaaaacagagauacagaccaauggaacagaacagaggccucagaaacaacaccacacaucuacaaccaucugaucuuugacaaaccugacaaaaacaagcaauggggaaaggauuuccuacuuaauaaaugguguugggaaaacuggcuagccauaugcgaagaacugaaacuggacaccuuccuuacaccuuauacaaaaauuaacucaagauggauuaaagacuuaaacuuaagaccuaaaaccauaaaauagcuuguuuuauaaauugugauucauaauucuaauauacaaagccuuuauaggucuguucuugcugccucugcugacuuuaggucguaccuuguuuucauacaugcuuaguaaugauuuuuacuauaagcaauuuacauuuccugaaaaauuauuuaugaaaauucuuugaguagaagucucuuugcugugucaagcuaccuggaguaccaccaguuuagggccacuuucaacuaaauaaauacaagguuuaaaguuuuguggacccacuuugcagauaugaauuugugcuugggauauucuaugguuucaaccuguucagggucugucugcuuuggaugaaggaauagauuuacuucugguucaccaaauugagaaagcagcuguuuggagauucaauucuauaagaggaguguaaaagccaacacucaaguuugccaguuuggaccaaugcucucagcucaacagaagcuuugugcuuugcuuacuuuucuggcuucccgucaucauuuggauuuuggccuuaucaguucuuaccuaagaagauuuauccaucauuuuaaaaaaguuuucaguuugggagauugguuagaauaccuagauaaucauauuccaguuuaacuuuuaaaguaaaauaaguaaacagauaaaauuaucuuagucuaacuagucagcauaaaaucaguuugugacaacauagucaacaguuaugaaaguguauguaaauaaacaguaguaguguuuuguuacuguucauugaugugaaaguacuguauuacaugaauauguuaaguaugcuaaagacaauagacuuugaguaucuauuaaaagacuguacuuucuucaucaaaaaaggcuagagggccaaucuuaagugaucuuaacugauacacuuuacuuccacauuaauauaugcaaugcacauagcaggagaaccuaacuugagaaucaauaccucauuaaauuauuaaaaaacuaaaacuacagaaaagugcuuguuauaacacaagaggaacuaccugaaaaugcauguucaguugcuuaaauguuuucaaacaaauaaaacuucuuugccaauuauaacuuaaauucagcaaauauuuaaaucaucuaaugaauaaauuugagucuugaaagauuguaucauacaaccauguguaccuucuuccucuaagucaaagguuuuaaaauaauuuuuggacccucaaaccccuuuaagcagucuaaagacagaucccuuuucaaaaugcuuucagaaaugcaugaauaaaucaaaucacaaaauuaguuauccugaaauaguuaucauacuauuacaagaaaaacaaagcuaugauauaguaacaaguguuucuuuaguaacacauuaaauaaugaggauucagcaauauaaugacuaccacaauuucuaaguagugaugagaauaaguauucugauauauauaacuacaauaugauacaaacaucuguaauuucucuaaguaauaaagucauagauacuaguuuugcugccuacauucauaaaagaaggaauugcuaaauuuuaauuggagugaaacuagaaaacuagaagagaccgauaaauuccugaacacauauccccuuccaagacugaaccaggaagaaauucauucccugaacagaccaauaaugagcucuacaguugaaucaguaauaaguagccuaccaaacaaaaaaugcccaggaccagauggauucacagaauucuacagcuguagaauucuacaaagagcugguaccacuccuacugaaacuauuccaaaagacugaggaggagggacuccuccccaccucauucuaugaagccagcaucauucugauaccaaaccuggcaaagaaaacaaaaaaagaaauauccuugaugaacacucaugcaaaaauccucaacaaaauacuugcaaaccaaauccagcagcacauugaaaagccaauccaccacagucaaguaggcuuuaucccugggaagccagguugguucaacauaugcaaaucaauaaaugugacucaucacauaaacagaacuaaagacaaaaaccacaugaucaucucaauaggugcagaaaaggcuucugauaaaguccaacaucccuucauguuaaaaacucucaauaaacuaggcacugaaggaauauaccucaaaauaaugagucaucuaugagauacucacagccaacauuauacugaauaggcaaaagcuggaagcacucccuuugaaaaccagcacaugacaaggaugcccucucaccacuccuauucaacauaguacugggaguccuguccagagcaaucggauaagagaaagaaauaaagggcauccaaauauaauagaaaggaagucaaaccaucccuauuugcugaugacaugaugauccuguauuuagaaaacaucauggucuuggcccaaaagcaccuucugcugauaaacaacucaagcaaaguuucaggacacaaaacucaauguacaggaaucacuagcauuucuauacaccaguaaggcaaucccauucacaauuggcauaaaaagaaugaaauaccuaggaauauggcuaacccggaagguggaugaucucuagaaugagaacuacugcucaaagaaaucagagacaacacaaaaaaauggaaaaacauuccauguucaugcauaggaagaaucaauauuguuaaaauggccauauugcccaaagcaauuuacagagucaaugcuauaccuaucaaacuaccaauuacauucuucacagaacuagaaaaacuauuuuaaaauucauaugaaacccuagaaaaguacccaaauugccaaggcaauccuaagcaaaaagaacaaagcuggagucaucacauuauccaacuucaaaugauacuacaaagcugcuacaguaaacaaaacagcaugguacugguagacagacgcauagaccaaugggacagaauagagagcccagaauaaagcugcacaccuaugaccaucugauuuuugacaaagcugacaaaaacaagcaauggggaaaggacacugaauaaauggugcugggaucaguggcuggcccuaugcagaagauugaaacuagaccccuucuugacaccauauacaaaaaucaacucaagauggacugaagacuuaaauguaaaacuuaaaacgauaaaaacuuuggaagacaaccugggcaacaccauucuggacauaggaauaugcaaagguuucaugacuaagaugugaaaagcaaucacaacaaaagcaaaauuugacaaaugggaucuaauuaaacuuaaaagcuucugcacagcaaaagaaacuaccaacagaguaaacagacuagcuauagaaugggagaaaauauuuacaaacuaugcauugacaaagguccaauauccagcaucuauaaagaaccuaaacaaauuuacaagaaaaaacaaccccauuauaaaaagugggcaaaggacauaaacagacacuucucaacagaauacauacacguggccaacaaguauauuaaaaaaagcucaauaucacugaucauuagagaagugcaaauaaaaacuacaaugagauaccaucucacacaagucauaaugguuauuauuaaaaagucaauaacagaugcuggugaguuuguguagaaaagaaaaugcuuauacacugcuagugggaguguaaauuaguucaaccguuauggaaagcaguguggcgauuccucaaauagcuaaagcagaaauaccauuugaccuagcaauccuaucacuggcuguauacccaaaggaauacaaaucauuuuaccauaaagacacaugcacauguauguucacugcagcacuauugacaguagcaaagacguggaaucaaccuaaaugcccaucaaugguagacuggauaaagaaaauggaauaguauugcagucauaaaaaagaacaauauaauguccauugcaggaacauggauggagcuggaggccaucauacuuagcaaacuacugcagaacagaaaaccaaauagugcauguuuucacuuauaagugaugagaacacaaggacauaaagagaaaaacaacagacacuggggccuacuuuaagggcagaggucaggaggagggagaaggucagaaaaaauaacuguuggguacuagguuuagcaccuggguaacaaaacaaucuguacaacuuuuuuuuuuuuuuuugcaugagagaaacaauucuuuuacauuaaugcuagguauagcuauccugguuucucuccaauuuacaaguucuuacaggauuuguaaucauacuuagcaaacuaaugcagaaacagaaaaccaaauagugcauguucucacuuauaagugaugaggacguauggauauaaagagggaaacaacagacacuggggccuacuugaggguagaggaugggaggaggaagaagaucagaaaaaauaacuauuggauauuaggcuuaguacccggguggcaaagucaucugugacaugaauuuaucuauauaacaaaccugcacguguucuccugagccuaaaauguaaguuaaaaagaggugaaugaaaaagauuuuucucuugcuguucauggaccccauaaaggguuaagugucaaaugaaguaaaccuggacagguucauuucacacagaaaaggcugucaaauaaaaaucauuuuaaaggaauggagcaacuuucuagggaaccuacggugaugagcuaaauauguggccaacuucuaacgaguacaccagcauuuucacugguuuauauuaaucucacuucugguuccauauucauacauuuuauuuuccucauuuaaaaaauuguaucuguuuuuauaagccacuguaugcuuuuuggaauaugagcauucuagaaauuuucugcaaauuaaauaguuaauaccuaauauaaauaugaauaaaauuaaacugaauuacucauuuuucccauuuuaauuacugcuuauaauuguuucucaagagagaauucuuuuacauuaaugcuauguauagcuacccugguuucucuuagauuuacucuugguaaguucuuacaggauuuguaaucauguaguccaaaauaaaucauucuauaagaacuacuuucacaucaagauaacuuuuauguauggaaucaacaacauugauaaagacuaaauuccagcacuaauccuuaugcaaauucucacagcauaauuuuacuuaggggaaaaaucuuauuugcaaguuaaauggcaaaguuugugguuagauaucuggauuucaaaaaaauugccuuagcaaauuaagaauaaaugauuuaacagcagaaauacucaaaugguacaacaggaucuuuauuuuucuugauaauccuaauugaacuauucuuucuuacuacaauuaaaggaccuggaaauuccaguauuuuguuauccaaacucuauuucagauuaccuuuuauucacagaguacuacccaccaaacauacauaagauaaaccugugucagaucauaauuuguaauuuuugauguggaaaauauuacaacuauaggccaggcaugguggcucaugccuguaaucccagcauuuugagaagccgaggcgggcggaucaccugagguuggaaguuugagaccagccugaccaauguggagaaacccugucucuacuaaaaauacaaaauuagcugggcaugguggcacaugccuguaauccuagcuacucaggaggcugaggcgggagaauugcuugaacgcgggaggcggagguugcggugagccaagauugcgccacugcacuccagcuuggggaacaagagugaaacucugucucaaaagaaaagaaaauauuacaacuacaaggacugucaaccuagaagcccaaguucuaaaaacagaaauaugaguauaggccaggugcuguggcucaugccuguaacccuagugcuuuugggaggcuagggcaggaggacugcuugagaccagaaguucaagaccagcacagaccacauagcuagucacugucucuucaaaaaauuuaaaaaauuaaaaaauuagcauuacaggucaugguagugcaugccuguagcccuagcuacucaagaggcugaggugggaggaucgcuugagcucaggaauuagaggcuauacugagcuaugaucaugcuacugagcuccagccugggcaacagagugagacucuguaucuuaaaaaaauuuucuucugaaagacaauaaauaauagaggcuuauauuaaguaacuauaauuauaaauauauagcuauugaaacuuucucaguuuagaaaucauuuucauuugaaauuuagugaaaaaguauuucaaaucuauaaaaauucaaguaccuuuagcaucauuaaaaauacuuuacauguauacauaccuauaauuugacaaacauuauugaauaccuauucuaucuguuagccuguuucagagcuugagauauaaaguugaguaagagaguccagauacucaagaaauuaguccagugaagaagacacaaguguaaacagugcaauguuugcauuagguagacgaguauacaaaaucuuacgggaguagaacacucagagaagggaagggaaacucagagcgcuggagccugcagaauaagcaagguuuucccaggaucaaauggagggggaugguggagaguaaaggagaagacuauugaggugggugacuaucauucuagucagaaaucauaguuaacugaaaagguguauguuuccaaucagguauggacuuuccacagacucucugaaucucauuauaaaagugccuuuugaaauguugugcagucacuuauuucacuauauuucuuuaaaaauucuccaaugcgggaggccgaggugggcgaucacgaggucaggaguucgagaccagccugaucaacaaggugaaacccugucucuacuaaaaauaccaaaaauuagcugggcguggugguacacgccuguaauccccgcuacucgggaugcugaggcaagagaauugcuuuaacccgggaggcagagguugcagugauccaagauugugccacugcacuccagccugggugacagagcaagacuccaucuaaaaaaaaaaaaaaacaaagaaaaaauuauuuaguacuacuuuuuuccccuacccuuaacauugcuuuaaaacucacuuugauuuuaaaaguauuuuaaaaaaagaaaauaucuuaaaugguucuuucauugguuucugcaagauuauuaaauccaauucugcuaccacaaauaaacacacauauguauauggcaguaguuuucaaaccaacuuaugcuuuaauauaaaaaaaucacaauguaauuucccuucacagaaauagaaaauaguuugguacaguaaaaaaaggcucuggagacagauaaucaacagagcucucucuaucuuuaccuacacuuuacuaguaugugaccuuagaaauuuuacuuaucuucuuuaggucucaguuucuucauccaugaaaugaggggguagaaguagaugaccuccaaagaccauucuaacuauacaauuuuagaggacucuuuaggguuuucuagauauaauuucaucagcaaacagagaaaauuugacuucuuuuccaauuuggaugcccuuuauuucuuucuguugcucgacugcucuggcuaggacuucccguacuauguugaauaguaguggugaaagugggcaucuuugucuuguuccaguucuuagggggaguguuuucaacuuuucuccauuuagcaugauauuggugguggguuuguuauagauggcuuuuauuauucugagguauguuccugcaaugccuaguuuguugagggguuuuaugaaagaaugcuggauuuuauaaaaugcuuuuucugugucuauugaagugaucauaugguuuuuguuuuuaauucuuuuuauaugaaugacauuuauugauugcauauguuaaaccaucuuugcaguugggcaugguggcucaugccuguaaucccagcacuuugggaagccaagauggguggaucaccugaggucaggaguucgagaccagccugaccaauguggagaaacuccguuucuacuaaaaauacaaaauuagccgggugugguggugcaugccuguaaucccagcuacuugggaggcugagggaaucgcuuggacccgggaggcggagguuguggugagccaauauugcgccauugcacuccagccuggguaacaagagugaaacuccgucucaaaacaacaacaacaacaaaaaaaaccaucuuugcaucccuggaauaaaacucaguuauucaugguauauuauauuuuugacauguguuggauuuggugugcuaguauuuuguuaaggauuucugcgucuauguucaccauggauacuggccugcagucuuuuuuuguguguguucuugccuggcuuuggaauucgggugauauuggcuucacagaaauuaguuagaaagaauucacuacaccucaauuuuugggaacaguaucaguaagauugguaccaguucuucuuugugcaucugguagagcuggcugugaacuugguccuuggcuuuuuguuauuuuguugggagaguuuuuacuacugauucaauuucacuauuaguuauuguucuguugaggauuucugauucuuccugguucaauguugcagggcgcuggauguuuccaagaauuuacccauuuccucuaggguuucuagucugugcauguaguuugugcaagacucaaggcaucucugaugauuuuuuguauuucugcaguaucaguuguaaugucaccuuugucauuucuaacuguugcuuaugugaaucaccuuuuuucccucaguuaauccagcuagcagucuaucaauuuuguuuaucuuuucaaagaaacuuuuguuuaauaagugacuucaguaaagucaaaaucaacauacaaaagucaguagcaauucuauccaccaauaaugaucugacggagaaccaaaucaagaacucaaucccauuuccaauaguuacaaaauauaaaauaucugggaguacauuuaaccaaggaggugaaaagucucuacaaggagaacuacaaaacaccgaugaaagaaaauguagaugaugacacaaacaaauggaaaaacaucccaugcuuauggauuggaagaaucaauauuguuaaaaugacuauacagcccaaagcaaucucaaucacuauuaaauuaucaacaacauuuuucaccaagucuaaaauucauauggaacccaaaaggagcucaacuagccaaagcaauccuaagcaaaaagaaccaagcuggaaucaucauauuauucgacuucaaauuacaccacaaggcuauaauaacaaaaacagugugguauuaguaugaaauagauauauagaucagcggaacaaagcagaacccagaaauaaagcuacauaccuacaaccaacugauguuugacaaagucaacaaaaauauacaauggggaaaaaagccuacucagucaauaaugcugggaaaacuggauagccauauacaaaagaaugacauugaacucauaucucuugccauauacaaaaauuaacugaagauugauuaaagauuuaaauguaagaccugaaacuauaaaaauccagggaaaacucuucuggagauuggucuaggcaugaauucaaaagcacgagaacaaaaacaaacagacaaaugggacuuaaaagcuucugcacagcaaaagaaguaaucaacagaguaaacacacaaccuacggaaugggagaaaauauuugcaaacugugcauccuacauagggcuaauaugcagaauuuaaagggaauucaaacaaccuaacaagaaaaauaacaaucccauuuaaaaagugggcaaaggacaugaacagacauucuuccaaagaagacauacaaguuuccaacaaauauaugaaaaaauguucaacaacucuaaucaugugaaaucacaaugagauaucaucuaacaccaguuagaaaggccauuauuaaaaagucaaauaacaacagauguuggcaaggauucccaccacacaauugguaggaauguaaauuagugccaccucuauggaaaauggugaacuaaaaauguaacuaccauucaaucuagcaaucccacuacuagguaucuacccaaaggaaaagaaauuauauauaaagacaccugcccuuguauguugaucacagcacuaucuacaauagcaaagucauggaaucaacuuguauccaucaauaaauggcuaaauacagaaaaugugguguauauauguacauacacaucauggaauucuacgcagccauaaaaaaugaaauuacgucuuuugcagcaguaugaauggaacuggaggccaugaccuuaaguauaaugacucagaaagccaaauacauguucuaaccuguaagugggagcuaagcaaugugacaaacacauugacauuguuugucaauguggcaaacagagugaaauaauagacauuggagaauccaaaaggugggaggggagugggggaugggaaacuacuuacuggguaccauuuacacuaaaagcccagacaucacuacgcaauguauccauguaacaaaaaugcauuuguacuccccaaaucuauucaaauaauaaaaaaguaaaaaauaauuauaaaauuuuuggucagcccuugacagaauaaaauaucacucucuugcccaauucuaguuuuucuauaucaacuugcagcgguaaauuauuuaaaaaaucacucucuaguaaauuaggaaccacauuucaugaaaaucuaauuugucauguuaauauacaucuaacagcagcaaagcucuaacaagaaccuuucuuagugugucauauauugaauaaaaacugguguaauccuggcacugucagauccaaugauaaugaaccagaguuucuuucacugccucaacauggaaucaagaguguaaagagacucugucaccgagaagcaaaagacucucuaaaggacaacgaacuaaaaugcuguuaggcugguuucucuuuucagcauaucugcccuacauuucauuugcauuuuguaaagugauaaaacacacuaauuggaaaacaaagcuuggcuaaaaaguuuauuucuguuaugcugccucuacauuuuaaugcuacuuugaaauguucauuuauauuccuuaaauuuucacuucugauucuuuagacaaauuuaugcagauaaucuuaaaacugcauuauuuaaaaauauuuuuauaacuuaacuuauaacuucauuugacauuuuuuccuuuauucagcggaaaagaauugaggaaauacccuugguauauauaaugauguauauaagcuauucaaauuauaauuuucuacuuaaauuuaaauuucauauacaguuuuuaacucaauauugucuuuucuuuuccaaaacagaguucaagaucguauuucuuuacucucgcccccuugauucccacccugcugguuauguauuuuaauaaggaaauauaggauuuuuauuuccuacauaauuuuguuugguguguggccagugcugacaacagcauuuugaacuacucaagacauguuaagaaagagcuguaauucuaaguaagcuuuuuuugcuuauugaguaagaaaaccuggcaauauuuacccaaguauguaguuuacaguagcuuuuuuguuguuuuuucaaagugcucucuacagagccagaggcauucucuagagucagugaagggccagcaaaggcagauaugggagauaacaguaggcuauaacuuuuauaaccuucaaccagaacagcaauuuugauucauauggugggcuuccauaaaagguuucuucugaauaaagauucuaugguuaaaauacuuugaaaucaaugaucuaggccuuauuuaucaucucugcugcuuugaaguaggggaaugagaaaaauagguuucuauuucguaucuuuuagagcagggaaaauucaaaaagaaaaugcguugagagucaguuuguacacagcauugucacuucuugaauugaugacagucauacacaugagaaauuuuucuaauguccacuuuuggggcuguuagaugagaaguggguaaaauuuauuacuagauaccugagaugacauaaaaucauuaguuccucuugucucagucauuuaaggaacagcagaaaaaaauaguuagaaaauaucugacucugcaugagacuaggcuuauucucauuuauuuggcaacuuacccuuagcauuuuucauauaauccauuucauuucuguaugcauaaaaaaaucccugaaauacugacugguuaaagauuauugguuuugauugcaauguguaagccagaaaacagcuucuccucuguguuuuggugauuaggaaauaaaaaauucauugcaagagguaaguguggugaucaaagguuacuuaugggcuaaacaaccugcacaaaguagaugaaaaaaauucugccuaucauaccauacuuaagcuuuaacaagaaaagaagggaaccagauauuggcucauagaauuaaugauuuauaucugaaaaaaguuuuucucaaagagcauuucaugaaauagucuugcaagaagcucuuuagucaauaggucaaugaauguaggaaauguauucucuuuuugaaaagcuacacaaagaauguaaccgucuaauagcuguaugguuaaggaacuuaauuucuuuaguccaauguuuccccaaauuuauuuugcugacaaacucccuuuucaagaacauauuacuaucuuacagaccuuuucuggaaaauugagaccagagaucugagaauagaggcuucuuaacaaaggcaaguauaucugguuucuaaguaaaauaucuggaaaaaacaaaaggauaacccagaaacuccauauacagagcucagagaaagguauaaagaauuaaguaaaaagaucuuagcuauggcuuuuuucccguagauguccagauuccugcucuuauugagaauauucuuuguguugcuaucaucaugaauaucauuaccauauaacaaugacagcggccacugcagcagcaaugcaaaguucuuaucaguagguacuacuacucucauuuuauagaugaggagacuaagucuuaauacaccaaaggucauauggcuaauaagugauuucagaugggauuaaaauauuuagcagccugagcuuuuaauacuuaugcuuucuauaucuaauauagaaggaaauggcaguuuggauacaucuuaaucguuuuccaugcauaagauuaauauacaauggaaauauauacuaugaauguuauacuucacuuugaaaacaacccuagguauuagguuuuuauugcuggguaacaaacuaccacaaacuuaacuuuaaaacgacacccaauuccauaggucaaaagugcaggcaggcauggcugguacucuuuuuagacucuaauaaagcugaaaccaaggugucagcuggucugggcucuuaucuagggacuaugugguauagaaucuauuucaagccucauucagguuuuuggcagaaucuaguuuagcguggauguaggacugaggucccuguuuccuugcuggcuggcugcugggagucauucucagcuucuggaggccacccauauuucuuagaucacugcccccuccguuuucaaagccaauagcacauuaaauccuucuuauguuucaaaucucccugacacccucuuuuccccuccucuucugcuaaaucugaagaaaguucuugguuuuuaaggacuuaggugauuagguuaaguuuacccagauaaucuauuuuaaguaaauugauucuguaaaaucauuucggcaguaccuagauuagcauuugacugaauuaacaaggaauaacaauuuuggaagcgggggcaucuucagaaucuugccuaccucaccaugcuugggggagauuaaaaaaaaaaaacuuuuacuuucuauuagccacuaauaguuuuagaaguuuauucagaauuuuuacuuuugugguuagagagugacauggaaauacugagacuuaaguguuucguguguguauaugugcgcacauuugcuaauaaaaacccagaacuuuauguuguuucuuugaagccaugaauauaaacgaguauacaacuaacucagaaauucaguuaaaugaaugucauuuugauuggacuguuacaaaaugaagaaaaaucacaauggcaguagaaauuaauacccgaauuauagacuuuuuaaaaaagaaaaguguauuauuuuuauuuacuuuuuuuuucuuuuuuuuuuuucgagaccgagugucacucuguugcccaggcuggggugcaguggcgugauuuuggcucauugcaaccucugccucccagguucaagcaguugucaugccucagccaccugaguagccaggacuacuggcgugagccaccacgcccagcuaauuuuuguauuuuuaguagagaugggguuucaccuuauuggccaggcuggucucgaacuccugagcucagaugaucuaccugccucggccucccaaagugcugggauuacuuauuuacuucuuugaggauguaaagaagcaaauaccagcuuagcagcacugaccucugcauaucuuuuuugcuauaguuuugaaguauuugaaaaaguugcauucaaaauuaacaacuuuugcaaauaacagaaaacauaagggaauauuaauauuuugauuaucucaaauaauguuccuguacaagaaaacuacgugauguaaaaauauuuauuguccaaauguauuuacauauuuaauucaauuuaaaugaguaucuccuaaaacaauucuuuuugaacuaaaagaaaugaggaaaaaucagaaauuaaacaauauucaaaacuauauaguaaauaaaacugaacaaaggaacagaauacagauagcuucagcuccaucuauaaacuuaucugauaaguuagguucauucauucccuaaaucacauauacacauaaaccucagguaaauugguauugaguuacauauaaucugaacacaaaguauuuaauauacagaguuuaugcuaaagaaaaaaaauaaugaagucagcaguaaaauguucuuuuaaucuuuuuuuuuuuuuuuuuuuuuuuugagacggagucucgccugucgcccaggccggacugcggacugcaguggcgcaaucucggcucacugcaagcuccgcuucccggguucacgccauucuccugccucagccucccgaguagcugggacuacaggcgcccaccaccgcgcccggcuaauuuuuuguauuuuuaguagagacgggguuucaccuuguuagccaggauggucucaaucuccugaccucaugauccacccgccucggccucccaaagugcugggauuacaggcgugagccaccgcgcccggccauguucuuuuaaucuuuacagcacuaaaauaaaaccacaaaacaaugguuugaauaaaaauauaaacaaacccaauaagaaaguaaaaaacaaacugaaagccauuaauacuaaucuauauuagaaaucacaaaacaaauacaaacauguaucuaaagucauaaauugcaaaaacuauaaaauuuacauauacacaaucaucacacaccagugacaaaaugaaaaaguuucagagcugugcugaucuauauugugucuuugcaucacagaagaagaauuuagaagaaaagguacccccagcuucuucaaauaaaaauguuaaguuagucuauucuguauaaacuaaagaacuguaugcaauggcccaaguugccugcccagagaggcuuuccagagcccaugaagaagcaaccuggcugugcaaaugugugucacacauacccugaaccuguaagugcacacacugccagcaaccuaugacaucccaguaagaugagcuugucagggucagaguaggaggugagcaaacacugggcauccuagagcagcaaguaggucagggagauguccccugggaugcacaauauggcugggaaagaggaagcaaugcuaugaguauuuggguaauaaaugaugauggucuuuuuuguugcuccagggcuggguuaggaggcaggaccaccauuuguucuuauuuaagucaguauaaacaucuacccaugugaauggcuuacuccuuggauguggcuaacuugugugguguggagucugaauacuauuaguggcaaccuuuuaaauuacuuuuaaaucaaaaugaaaauauuuaguaagaacuaugaaacauucauagucuuugaacugcaauguuacuauaaauuuucucuuaaggauaacaugauagaaacaaagacaugaagcaugaacuugauuauacagccauuaaaaauaaacaugaagaccacacuagauacagaauguuuacccugacaguaaaaacagaauauaaauauacagauuuugaaagcagcaauguaaaaacauauaagaaaauagaagauaauaguaauucugagauaguaaaaucauuacagaauauuuuuuaaauucuauaauuuuuaaaauaaaaaucaaguuguuauucuuaaaugcuuaaauacuucuuauuuauuuguuaaaaauccuuuuuccaguuagcaaagauaaauuuuugauuagauguuaaucauaaauucaaacuaaugugauuuuaauauaugucagugauuuacuugugaaaguguauauacuuaaugaaacauuuggcuuucaaguuuuaacaaggcuauuuguacaggguguccacuccuauguuccuaaaaguagagaauauauaauauuacuuacaagugugggaagccaguaucagaacuucuauuuaucugugauuuuaauuucugaaagaaaugaagcuguacugauauuuaauacaugaaaugacacuucagacccugugaugauuaauauuaugcaucaaccugacuaggccauaguaccuagauauuugaucaaauaccuguuuagaugucguugugaaggcacuuagaugaaauuaacuuuaaauuagcagacuuugaguaaagcagacuacucucuacaaugugggugggccucauccaaucaguugaaggccuuaauagaaaaagacugaguuugcucccagaaaggaaauucagccuccagauucaagcugcaauaucaacuuuuccauggguguccagccuacuagccugcccugcagauuuuggaccugccagcccccacgauucaugugcaucaguuccuuaaaauaaguuucuaucucuauauauacaguuaugagccacauaacaacguuuucagucaauaauggauggcauauaugaugguggucucauaaacauaauggagcugaaaacuuccuauugccuagugaugauuuagugcaaugcauuacuaacauuugcggaguugcugguauaaacaauucugcauugccagucuuggaaaaguaaagcacacagaauuauguacaguauauaauaccugauacugauaauaauuauugguuauguauuuacuacacuuuuguuauauuaguguauuccuucaggcaggucccucaggagguauuccauaaguauuguugccaugggagaugagagcuccuuugccaguaaugaccugccagugggacaaaauuuggaaguggaagacagugauauuaauggucccgacccuguguaggucuagacuaacaaauguguuugugucuuagcuuuuaccaaaaaaguuuaaaaaguaaaaaaaacaaaauuuaaaagcuuauagaauaagaauauaaaggaagaaauuauuuuuuacaauguguguuuucagcuaaguguuacugcaaaggagucaaaaaguuaaaaauauuaaaaaauuuauaaagcaaaacagaguaagcuacgauugauuuuacugaaaaugaaacuuaaaaaguaaauauaguauagcuuaagugcacaguguuuauaaagucuauaguaguauacaguaauguuauaggccuucacauucacucaccacucauucacucucacccagagcaacuucuagucccguaaguuccauucgugguaagugcacuauacagguauaccauuuuuaaucuuuuauaaucauauuucuauggugccuuuucuauguuuagauacacaaauaccauuguuacaacugccuucaguauucaguacaaaacaugcuuugcagguuuguagccuaggagcaaaugacuauaccauauagccuacagguauguauaggcuauaccaucuagguuugugaaaguacacucuauguucacacaacgauugacuaaugacacauuucucagaaugcaucccuguuguuaagugacacauggcuauauauauauacccauucuauucuguucuguuccucuggagaacccuaauacacaacccuacacagacaacccuguuaucugaugguugagcuuucuguuuguuaaggaggaauaacaauggcaucccugcuauucguucccuuauugcauccugcgacuguauugaguuuucuugcucuuaguuaagugcauacagugaauuauugacuuaauuaaacuaagucucacaaaggaguagcucaucaagauucuuugcaaaaaaaacuaaaacuaauacaaaugcaagaaaaaaagucaacagauuugccaggcgccguggcucacgccuguaaucccagcacuuugggaggccgaggcggguggaucacgaggucaggggucaggagaucgagaccauccaggcuaacacggugaaaccccaucucuacuaaaaaaauacaaaaaaauuagccgggcaugguggcgggcgcuuguagucccagcuacucgggaggcugggacaggagaauggcgugaaccggggaggcggagcuugcagugagccgagauuaugccacugcacuccagccuggggugacagagcaagacucugucucaaaaaaaaaaaaaaaaaaaaaaagucaacagauuugauacuucucuuccuaguaaaaacacucuuugcaauagugaggcaaaaagugacuaaaucagauccugacaaaagcuggaaaaaacuauaaaaaaggcuaacguaaauacagauuuacauuugcucauaucauugcccuaagugauuaugucuugagauauggguguacaacacaggugaguuauaauaauauuuuaaaauauuauuuccuucaauuauuucaucucuuauuuauagcacaaauaacuugcuggcaaccuauacugcaguaguuuuugacaacuaaauuuugugguaggacauguuucuuuaacaaaggggaaguaucuagugcuuaagaauacauuuuauauuucauagaaauuucuuaugauuuaauacacuuaucagucuucuuaaaaaugacuuagugagcugagugugguggcaugcaccuguagucccaguuacuugagaggcugaggugggaagauuguuugagcccagccuggucaauacugucagaccccaucucaagacaacagaauuucuugauaauaggaguauacaucaugaccguuagugauuuuuauagacauauaggaguuggcuucuacaauaaauauggcuguuuuuggaauuauuuauugcuuuucucuaaaacaguuggucccuugacucacugucacauuuucuuauuaauaaaucugauccuucugucuucuugagguuucuaaucugcuaugcuugaaaaauucucuccucuucauuaaauauaagucagcuaaaaguggaccuacugucugaugcaaacuaggguaaggaacuaaauaguacagccauuagauuacgaacaucuucugaagauauaaaguccccuuuuuaaaaaaaccuuuucccgaauagucuacucccuaacauuuuaauccuuuguuuuucuccuugggaucauccauaauguuuucaucuguuguauuuaugauuccauccuauucuaaauacuuugggucacaucguuguacuaaaugguaaacaauugaaaagaggccagguacagcggcucaggccuuuaauccaagaacguugggaggcugaggcaggguggaucauuugagcucaggaguuccagaccaggcugggcaacauuggugaagcccugucucuacaaaaaauaaaaaauuaggugggcaugguggcacaugccuguaguucaagauacuugggaggcugaggcaggagaauuguuugagcccagcagguggagguugugguaagcuaggaucacgccacugcacuccagccugggcgacaggaaugagacuguuuuuuguuuugagacaaacaaaacauggaaaacauggaagagaucuucuagggguaaaaagaaaacagaggauuauuaauuuucccuguuucaaaccucaauguugucaucuccauauuauaacguuagaguuaacuuaaucaugagauuggcacuauugggcauucggaaauuaacucuauggucccuucucacagagaauuuauucauucacucaauuauuggauugcauuauauacaaggcuacuggugccaggccuugagacguagaaaauaauauaguucuaacauguuuucauggagcuuuacaaucuaauacaaugguauggaaaauuaaaaugcuccuugggccaguuauuaagugaagaauuaaugguuuuagaauucucuaaccugggcuggauaugguggcucaugccuguaaucucagcacuuugggaggccaagguggguggaucaccugaggucaggaauuugagaccagccuggccaacauggggaaacccugucucuacuaaagauacaaaaauuagcagggugugguggaagacaccuguaaucccagcuacucuggaggcugaggcaggagaaucgcuugaacccaggacguggagguuguagugagcugagaucaugccacuguacuccagccugggcgacagcgugagacuccaaaaaaaaaaagggggugggggcuagaauucucuaacccuuucuuaaguucucagccacuaugacagcugaugaaacucuggcaucacacuacuugacuucaaacuauacuacagggcuacaguauccaaaacagcauggcacugguuuaaaaaaauacauauauauaggccaauggaacagaauagagaaucccgaaauaagaucacacaccuacaagcaucugaucuucgacaaaacucaaagaaacaagcaauggagaaagaauucucuauucaauaaauggugccaggauaacugguuaguuauagucagaaguuugaaacuggaucccuuccuuaagccauacacaaaaauaaaaucaagauggauuaaagacuuacagauacaacucaaaaguauaaaucccugaaagacaaccucggcaauaccauucaggacauaagcaaaggcaaauacuucgugaugaagaugcuaaaagcaguugcacaaaagcaaaaauugacaaaugaaaucuaauuaaaauaaagagcuucugcauagcaaaagaaacugucaacagagugaacagacaacguacagaaugggagaaaauuuuuguaaguuauguaucugacaaaggucuaguauccagcaucuacaacgaacuuaaacaaauuuacaagaaaaaaaacaacuccauuaaaaagugggcaaaggacaugaacacuuuucuaaagaugacauacacacagccaagaaucauaugaagaaaagcuugauaucacuuaucauuagagaaaugcaaaugaaaaccgcaaugagauaccaucucacgucggucagaugucaaaaaauaacagaugcuagcaagguuguggggaaaaaggaaugcuuacacacuccuggugggagcguaaacuaguucaaccauuguggaagacaguguggugauuccucaaugaacaaaagaaauaacuuuccaucccauuacugggcauauacccaaagaaauauaaaucauucuauuauaaagacacaugcacauguauguucacugcagcacuauucacaauagcaaagacauggaaucaaccuaaaugcccgucaacaguagacuggauaaagaaaaugugguacauauacaccacggaauacuaugcagcuauaaaaaaaugagaucauauccuuugcagggacaauggccaugguggccauuauccucagcaaacuaacgcaggaacagaaaaccagauaccacauguucucacuuauaggugggagcuaaaugagaaaacauggacacagagggggacaacccacauugaaaccuauuggagggugggaaaauggagaggaucaagaaaaauaacuaauggguacuaggcuuaauaccugggugaugaaauaaucuguacaacaaacccccaugacacaaguuuaccuauguaacaaaccuacacuuguaccccugaauuuaaaaguuaaaaaaaaaaucuggcauuuggacauggguucuccuguguuuuuaugauaaaguuuaaugauaggauacugugaauucuauuuguauucaaccuggaguuaauccauaacaguacaaagaucuuugggggguaggcuuuuccucaagaaugauucuuaaacaaauacugcuuaaaggcuuagagagugacugaguacuucacucugaaguacuugaccacucuacacucauauuuacagcugaaaguucuguguuuuaaccacuaucaaauuaacacagguaacaauauuucuuuggaguccaaaaccacugcuuuggagaacugaggugggaaaauaauccagauggcuaaaguucuucaaaaauuuauauauuuuucuuuuuugagacagggucucucucugucaccuaggcucgagugcaguggcacaaucacagcugacugcaaccuugaccucucgggcuuaagugauccucccgccucagucucccaaguagcuaggacagaggugcguagcaccgugccccacuaauuuuuauauuuauuguagagaugggguuuugccauguuguccaggcuggucucaaacuccuggacucaagugauccgcuugccuugaccucuaaaacugcugggauuacaggugugagccaccagcccuggccuaaaaauuucuguauuucaaagauggcuuccaccuguaguucacauuucaucuuugguuagauuuaaaauuaacgcuauacucuuaauuuuaaaauuuuaaaauuggcauucucagucgggcacaguggcuuaugccuuaaacccagcacuuuggguggcuaauaugggaggaucacuugaggccaggaguucgagaccaaccuaggcaacacagcaagaccccccaucucucucuuuuuuuugagauagagucucucucugucaccaggcuggagugcaguggugcaaucucagcucacugcaaccucugccuccuggguucaagggauucucgugccucagccucccaaguagcugggauuacaggcacacgccaccauacccagcuaauuuuuguauuuuuagugaagacaggguuucgccauguuggccaggauggucucaaucuccugaacuugugauccgcccgccuaggccucccaaagugcugggauugcaggcgugagccuccaugccuggugucccgucucauucauauauauauauauuucauauauauacauauauucauauauauaucauauauacauauauucauauauauauuucauacauacauauauucauauauauuucauauauacauauauucauauauauuucauauauacauauauucauauauauuucauauauacauauauucauauauauauuucauauauauucauucauauauauacuuauuuauauauuuauucauauauauauauuuaucuauauacauauauuugcuacuugggagguugaggggaaggacugcaugagcccaggaguccacuaugaugagcuaugauugcaccacuucacuccagccugggcaacacagcaagacccugucucuuaaaacaaaauaccuaaaaaacucaugauauucuccagaaauaaagcaauuacccucuaacauucuauauuagauuauucaacuauauacuaacuauuuacaugccaggcauuccacagguuucaauaauacagugauaaagaagacaaagcuauuauccuuaaauacacacagcuaaaauauaauuuagguaauugcuauauaaauaaaaugcuuuaugaauuauuuuuacaugcuuuucuguauagagagcugaacugaggaagaaugugaaccauacacaauauaauaaauguauaauacuacugaggacuguaauuuaaaaaacaaagaauaagauuugagauuaaaugucuauauauuuuuccauauacaguugcucaauaccaggaauuuggcuauuauccacauaguaagaauaagcuuacaauggaauauauuauaaaacuuggaauagggaaacaucucagaauucugugcaacauuacaacuaaagaagccaccucugccuuuggccgacccacagcuagguaaucuccccaggccaagugaaacagggagagugaaaaagagccagggaaggaagggcgugaguucuaguggccaccugccugcggcuacacagcaguugccugguaaaaugaaagaagucaggaagggaguugggugcaacccaagaagagggcucuucuacagaguuucaguuucuguuguaccucuuuaaauagcagcugccccauaaacuucaugguagaagguuuagaaagccaaagacucaaccuccauucuccacuauaggucccaaacauagacucugcccaggccugaauacuacaucucgaaaguguuuaaaaauuuccuuuguuuuccaauuagcagcagacuucauacuaaucccugcuuuucuuaccugcuuuuuuuccuccucucaagaugcuuucaaacaauguuacugcuauacuuucucaaaagaaugcgauuguaaacaaacuggggaagacauuaaauaccagaugaaggaauuuaaaaauugggcucuguuuuccccugcauaugccauugucaauuauacguuuuuguaauguccaucauuugauacaaauuacuggaaaacugaaacacaauacagccaaaauguuucaacaucuccaaaggacugcacuagcucccuagcaauggauccuaaccugaaugaaaugaaaauuaaaauagugucagggauaagaagcuuaguugucaaucuuaauacaauugagacaaagauaaaauucauucagcuugcuuaaaacagugaauuuucaaccucucaauuuuguaaucacuggacacguaauugaaaagcuaaaaauucaaucguguacucaauuuuaugaauauuaaagaacauguauaacuacugaaaauauauuguuacuaauucuguucaaagcaugaggcauaauuaauaauuuucuauuucucaaggaaauggaauuaaaagucuucuuauaacuguccaacuucugaauuucauauuacucuuauaaaaauuuucaggaauucuuuaugauacaaaacuacccauacgugaagaaguuauggugucuauagguacaaugccacuuaguaugcugacagucuaaguaaaauuauuuucuuacuauaguaauaggauaggauuuugcaugugucaaaacuuuuggauaauguuccugaauggauaaaucauaaaacauggaauaauauucuaaaaagcacaagacuuuucuaaacucugcagaaaagaacuauauuuaaauaaaaugccuaucaguuagcuuguuuaccaaauacaguuaauauuuaaaagcaaaacaugaaaaauuauggcuuugcuuuagaacagggguccccaaccucugggcugcaaacugguauugguccguggccuguuaggaaccgggcugcauagcaggaggugagcggccaguaagcauuaccaccugagcucugccuucuguuagaucagcagcagcauuagauucucauaggagcaugaacccuacugugaaaugcacaugcaaaggaucuagguggagugcuccuuaugagaaucuaaugccugaugaucugagguggaaaaguuucauuccgaaaccacccuucaccccuguccauggaaaaauugucuuccacgaaacuggucucuggugccaaaaggguuggggacugcugcucaagaacaccuuacacuugcaaacuacuaugucuacuauuaagcaaccaagaguuuugucuuuuuuccccaaaaaugguggauuagaggcuuucagcauuacccauccacuuggaaauagcaaaaauagugcguaaagaucaauauguaacuuuaauucaagaaggaaaaugggaauucaccagacuaguaaaggauacccuagacccuggggaggagaaggcaagccagcaauccucgugaagguguuuggcugguuacaugaaugaaagccccaguaugugaaaggggcagucugucuuccugugugucucacuuuucugcuaguuaucuguauaacccaggcaaagggagagcgcccuguuucucccaaaacugggagguaguguggggaaaggcuaagagauagugagggaaagacaccaggaagcugcaggcauuuucccagaccuaggacugagaggaggacaccauuucaaauucaggcucacacaaagucagucacuguuuggccaccuggcaacagcagccacugcagacauuuuaguaucagucagagacuggagugcuugcucuggagcagggaaaaggcccccacagccagaaucaggcagugaguguggagagugccccagcaguaguugcuggaauuaggcugucuccuguugcaagaccggaguggaaggagaguugcugaagcugguauuucuccuacgugguuugacuugcagccagggacagcuuugugaccuggaacaagucugcaugggucacugcugggugucccgggcugcuuccuugguugguugcgggacaguagcccaccaguccaaagacagggagggaagcagucuccaguccccuggagauuuaaccuucaguguggacugccccaacagaaggaggaacguggccugccaaagccuuccuugggucaaaggaaacaaaagugaagcacaagccacugaagggggcaacagcaaagccaaggaaugaauucggagaguggggguaaucucucgcccccagccccgcucauuagugcacugggacgaaugcggcagcagcucuacaugcuggggaccagagcgugugggcugagagaggugcugugcaggccucuccagcagcuccacucccgcugaagaccaguggcacuggcgggauaaggaugcuucuuuugccucugucgccuccugcuggcucuuacucauaagcgccaucuacuggacggcagccugaauuacaccaccaaacaagaauacaucucuacaccaagcaacauccgagaaagccacuguagaaacuaucugcaaccaaggaacccauaacacaugaauacacccagaaaugaaaucaaaugaucauauucaacauacaccagucauaucaacgaaauaaagcauaaaaauuaaaaaaaaaaaccaucccaaugauagcaaauucaaaaaaagcagcaccaguuuccucggaugagaaggaacaagcacaagaacuucggcaauuauagaaauccaguguuccaucaccuccaaaggaucacaugagcucccuagcaauggauccuaaucagaauaaaaugacugaaaugauacagaauucagaauauggauggcaagaaaacucaacaagauucaagagaaaguugaaauucaacagaaaacagaaaaaugauccaggaguugaaagauaauauaaccauauuaagaaagaaccaaccagaacaucuggaauuaaaaaauucacuagaggaauuucaaaauacaguuggaagccuuaacagacuagacaaagcagaagaaagaauuucagagcucaaagacugguucuucaaaucaacccugucaaauaaaaauaagaagaagaaaagaacacaaagccuuggggaaauaagggauuauguaaagcgaucaaaucuacaacuuacuggcauuccugagagagaagagaaaacaagccacuuggaaaacauacaugaggacauaauucaugaaaauuucccccaucuugguagagagguugacauacagaugcagaaauccagagaaguccugugagauacuagacaaaaugaccauccccaaggcacauagucacuagacuauccaaggucaaagcaaaagaaaaaaucucaaagauuaccuauaaagggaaacccaucuggcuaacaauagauuucugaggagaaaucuuacaagccauaagagauugggcucccgcucccugccuuuuuaaaacaacauucuuaaaagaaaagaaaugccagcgaagaauuucauaucccaccaaacuaagcuucauauaugaaggagaaauaaaguauuuuucagacaagcagucgcuaagagaauucacugccaucacaggcccuacaagagauacuuaagggaguucuaaacaaggaaaaagaacaauauucccuacuacaaaagcauacauaaacacacagcucacagauccuauaaagcaacuacguaauugagacuacaaagcaacuaauaacacuaugaaagaaacacaaccucucauaucaauauuaaccuugaauguaacugaccuaaaugcuccauuagaaagacauaaguuggaaauuggauuaaaaaaaaaaaaaaacccacccaucuucugucuuugagagacccaucucacauguaauacacagucucaaaguaaagggauagagaaagaucuauugcauaaauggaauauaaaaaaaaacaggggucacuauucuuuuaucagauaaaacacaauuuaaaccaauaguaacaaagcacagagaagggcacuacauaaugauaaagagcucaauuccaugagaagacugaacuacccuaaauaauauagcacccaauguuggagcaugcagauucauaaaauaauuacuucuauagucaggaaaagacucagacagccacaggguaauagugggggacuucaccucauucacagcuuagaucauugaggcaaaaaacuaaaauucuggacuuaaauuugacacuugaccaacuggaccuaacagacauccacagacaacuucacccaacaaccacauaaaacacauucuucugucaucuacacacagaacguagucuaagauggaccacaugcucaguuauaaagcaagucucaauaaauuuuaaaaaggucaaagucauaucaagcauauucucauaucacagaggaauaaaaauagaaaucaauaucaagaggaacucucaauaccacacaauuacauggaaacuaaauuaacuugcuccugaaugacuuuuggguaaacaaugaaauuaaggcauaaaucaaaaacuauuugaaacaaaugaaaauauaaacacaacauaccaaaaccucuacaaugcagcaaaagcagcauuaagagaaaaguuuguagugcuaaaugccacaccaagauaggaaggucucaaauuaacaaucuacuauuguaccuaaagaaacuggaaaaacacaaacugauugcaaugcuagcagaagaaaaaaguaacuaaaauuagagcagaaguaaaugaaaucaagaacaaaaaaccauacaaaugaucaauguuaauagcauaaacaagauugacagaccacuaguuaaacaaagaccacuaguuaaacaaacaaccagaauauucaaauaagcaaaaucagaaaugacaaggugacaugauaccaaucccaaagaaauacaagagaucccuagagacuacuacgaacaccucuaugcucacaaaauagaaauucuagaggaaauuccuaaaaacacacaauguccaaagauuaaauugggaagaaauugaaacccugaagagaccaauguguuccgaaauugaaucaguaauuaauaaaauccagaccagaggaauucauagccgaauucuaccagaagcacaaaaaauaacugguaucaauccuauuggaacuauccccccaaaaaaaucgaggaggaggaauucguuccuaacucauucuaugaaaccaguaucacccugaugccaaaucuagcaaagacacaaugaaaaaacaacaauaaacuacagccaauauacuugaugaacauggaugaaaaaauccacaguaaaauacuagcaaaccaaauccagcagcacaucagaaaguuaauucaugauuaaguaggccuuauuccuagguugcaagauugauucaacacauacaaaucaauaaagucauucaccacauaaacagaauuaaaaaccauaugaucaucucacuagauacagaaaaagcaauagaaaaauccagcauuccuucaugauaaaaauccucaacaaacuaggcaucuaaagaauauacuucaaaauaauaagagccaccgaugacaaacccacauccaacaucaugcugaacuggcaaaagcugguagcauucuaccuaagaauugcaacaagacaaaauguccacucucaucacuccuauucaacauaguugaacauaaaaugauaaugaaguccuagccagagcaaucaagaaagagaaauaaaaggcauccaaauaggaagagaggaagucaauuaucucucuucacugaugguaugauucuguucuucagaaaauucuagagacuccaccaaaagucuccuaaacagucagugaaguuucaggauacaaaaucaauguauaaaaaucaguaguaaaaaaaaaaaaaagaaauuuaaaaaaucaguagcauuucuauacuauuuauaauggccauucuacaccaguaacacucaagcuaagaaccaaaucaagaaugcaguccccuuuacaguagcugugugcgugugugcacgugcgugcacacacccacacacccacacacacacacaaauaccuaggaauauauccaaccaaggaggugaaagaucucugacaaagagaacuauaaaacucugcuaaaaaaaaaauuacaggugacauaaacaaauggaaaaacaucccaugcucaugaacuggaugaaucaguauuguuaaaauguccauacugcccaaggcaauguacagauucaaugcucuuccuaucaaaucaccaauguuauuuuucacagaauuaaaaaaaaaacuauucuaaaauucacauggaaccaaaaaagagcccaaauagccaaagcaauccucagccaaaguuaaaaagcuggagacaucacauuacccaauugcaaacuacaauacaaggcuacaguaugcaaaauagcauggcacugguacaaacacagauacauacacuaauggaacagaauaaagaacccagaaauaaagccacacacaaggagcugauuuucaaacaagucaauaaaaauaagcaauggggaaagaagucccuauuuaauaaauggugcuggggaaucuggcuacccacaugcagaagaaugaaacuggacccuuaccucucagcauauagaaaaauuaaugcaagauggguuaaaggcuuacgugaagaccacaaacuauaaaaaugcuagaauaaaaucuaggaaacacuguaguggacauuggccuaggcaaagaauauaugacuaaauccuacaaagcaauugcuacaaaaacaaaaacugacaaguggaaccuaauuaaacuaaagagcuucugcaccgcaaaagaaacuaucaauaaacagacaaccuagagaauaggagaaaauauuugcaaacuauggaucugacaaagcuguaguaucuagaaucuauaagaaacuuauaucaacaagcaaaaaacaaauuacccuauuaaaaagugggcuaaggacaugaacagauauuuaauagaagacauaccuguggcuaacaaacguugaaaaaaauguuccacgucacuaaucaucagaaaugcaaaucaaaaccacaaugagacaccgucucauaucagucagaauggcuauuaucaaaaagccaaaaaacagauguuggcagggauacagagaaaagggaacacauacauuguuggugggaauguaaauuaguuuagcccacaugaaaagugguuuggaguuucucagaaaacuaaaacuagaacuaccauuugacccaucaaucccauuacugaguauauacccaaaggaaaauaaaaaauaccaaaaagacagcuguacccuuauguuuaucacagcacuaucuacaauagcaaagacacaaaaucaaccuagguguccaucaauaguggacuaaagaaaaugugauacauguguaccacagaauacuaugcagccauaaaaaagaagaaaaucauguccucugcagcaacaugaugcagcuggaggcauguucucacuuccaagugggaacuaaacacuggguacauagggacauaaagaugagaacaaggcacuggggacuccaaacguagaggagggagguaggaggguaagggauaaaaaacuucccauuagguacucuauucacuaucugagugaugguaucaagagaagcccaaaccucaguaucacgcaacauauccuuguaacaaguaccccuugaaucuaaaaauaaagcaaccaagaguaauaauacagaaauauguugaauuaaauauaaacuuagccaucuguaacuuuacauauauuuaucugucuuaaucuugauguuuaaaaaaaccuuacccuucuuuuauuacuuuccauguuaccuagcuagaaauacaguaacacucagcaaauauuuuuuugaaugacugaaaauauaucauucuaugugcugucauaaccacauaaaaccagucugguucaacuuuuauguaaaaaagcugugagcuauuuuucaguucccauggacccuuaggucacauaaccugauaagcccagaucaacuaagcaugcaaucacagggggaaucuaagugcuaagcgcuuagacuaaggaaagaaguggaugcugcauggcaguauccgugauccaauccgauugaggucugguaucacccaucacaggauucagucagaugaugccucuggugucaccugacugcaagauccaaucacaucucaccucauuacccugugcuuauaaaaccugacccagcccccagcucagaggggcacugcuuugggaacucuuccugcuguucuccuuacuuguaauaaguaacaaaauucccuugaucuuuaguuguggucacuggguugauaaccagcaagugaucaaacccacggguugugugaguaacauucugguugcuugaggcuacuugguacugucauggauaaagcagaaaauuuuucugcuuuucaauuauagcuuuucagacugaauaacuuuucaauuccaauagucucuaccuuuucucuucuucuaagcucucuccauccccuaauuuuguuaauacuguguauuagcauuaaaaaugaauuuaccuuagauauucaaaagauuaauauuuuucacuauagauuuacagguacagaauaauaugugcuauagucaaguuagguagaacugaucugaauuucccucaaggcauuaccccuuaaccuuucccuaucacacuccucuuaagaguaucauuacucuauaaacaucccacuugaacuucaaaucauugaaauuuagaugucacccuuaacauugcacaaaucccucucaaggucaaugaugacuuaaucauuaaauccaagaacauccucuuaaucuguaucccacugaugacugacuuucugaacuguuacguucacuguggcuucaucauuguuauacguaagccuucucuaaaguuccacaguugaaguuucucucuuucuauuuuaucaucuuucuccagacugauucagguuauguuccagaugacaugugguuccaccaaucaaaauaaugccaaauguaguagagacuuuuuuuugaaacagggucucgcucugucacucaggcuggagugcaguggugcaaucuuagcucaccacagccuccgccuccugagcucaagugauccucccaccucagcgucccaaguaacugggacuacaggcacaugccaccaugcuuggcuauuuuuuguaucuuuuuuaaaggugagguuuugcaugcuguccuagcuggucucaaacucccggccucaagcgaucugccugucucaaccuuccaaagugcuagaauuacaggcaugcaccacugcaccuggacugcaguugagacuucuguaacuauuuucugauuuuugaacguguuucuuagguccaggcucauauuuucaacaacaugcaagauaaauauuuuggcaaaggaguccuggaaauacguacaaauucaauuuaucccaaaccauacuaaacuucccauuccuuaacucuuuuucucauuuuuuaccccauaauauguucucuaccccacaauauaucuucuacucugugaaauaacgcuaaguucagcacaaccuuuguauuucccuaccucaaccagguauuacaacuccguaaaaucucuuguacuuaucuucuuucuggaucuacccagaguucacagucucaucuauuauuacuguaauugguuucuccauuaaagaguaucuuucaacccauauaacaguguauggaugcagagaccuccucuuaaaaauauauuguuucuuaagauguuaagauggcuucaccuguacugcagaaacacaggaugaauugcuuggcauaauauucaaagcucuuuauuaucuaaaacucagucagcuguacuagucacuguuuucugaaaauacaauguauuuauguacuuauacgucuuuguuaaucuuuucuuucucacuguuaagcccucauuccuuugcgagucauccuucaagguucacaccaaauauuagcucugagauaaauucaucaaaucuucccauaaaaauuaucauuaauuccucugccuucacagcacauucccuuuuacuccauuuauaacacucucuugcuaguugcauucaugguccacuggacuaugagaucacuguaaauguaagagggugcaaaagaggaagaaacaugcucuauuuaucuuuguaacccuuuaugacuaaccuauguuaacagcacaugcuugcugaacuuaacaaguauuuacugagggccuaguaugugcugccaguuuucuaggagcuaaguuauccacaaggcagauguggacuuuacuuccagaguuuacaauguguucuaacaggaaagacagaccauaaauaauuauaguaaaaucuaagaaaaguuagaauaaaaauaaaauguguuacagcagggguuuucaaauguuuuggucucagaacucuuuuguacucuuaaaaauuaccaaauacccaaaaagagcauuuguuuaugcgggcuaaauguauugcuauuuaccauauuagaacguauaggugaaauacuuuuaaaaaauguauuaacucauugaaaauagcaaugauaaaaccaucauauacgaacauaaauaauuucuguaaaagaacuaugguuuucaaaacaaaaaauuuaucaauaagaauggcauucauauuuuuguaaauuucuaguguauggcugguauaguuuggauauuuguccccauucaaaucucacguugaauuguaauccccaaugcuggagguggggccugguaggaggugucuagaucaugggggcagaccccucaugaauuaaugcuaucacugcaacagugaguucuugugagaccuugugagaccuugugaguucuuguguguggcaacuccccgaagucccccaaacuugcuccugcuuuuaccaugugacacgcaaguuccugcuucgccuuccgcugugaauaauagcuuccugaggccuucccagaagcugagcaauguugauguuaugcuucuuauauagccugcagaaccauaagccaauuaaaccucuuuucuuguaaauuauccggucucagguuauagauagcaaugugagaacagcuuaacacaauggcuaaaccgaaaauggcuggauaacugucauaccaucauguuuuagcauguagcagaaguacuuuuucugcgcuucccauuucaucauguaacacaaacacaauuacucaagaguuuaguuuaauaaaauuaauuuuuacugcuucauccaugacauuuuuaaguaaaacuggcuuuaaaagaaauugcuaauguaugaagaaugcaaugacuauuacuauaguuuggugcaacugccuugauuugugccaaggugccagcaguuuuauccacuguugcuuuugaacuaucaguacaaauugcaacacaauaaaaaaggcaaauaauguuuuaguaugaauauaaaaauucuuugcauucacagaccauucucuuccucccccaacucuaugaaagggcuucugagacuccuagggauccacagagcacacugagauuugcugugcuagagaaguaugcacccuguugauaacaacucuaggaguaaaggaaguuaucuaucagaaaguuuaauauuugacacuauaucuaaggacaaacaggaaauuauccuggugaagggaauaaguaauggguuguaaaaggauguucuaggcagaagggaaacacuaggcaugagcuggaauuuugcaggagcaaaaugaaguucaauauuacugaguuauacaguuaaaaauguacugagaaaugagggaggcauauuuauguuauauuaaggaacuugaauuuuaucucaaaggcaaagugacaucacuaaaaaguuuuaguaaaagagcuggcauuauuggguuuguauuucaaagaaacucucaaguugaauugugaaaaacagauuggaguaaaacuggaaaaagagacuacuuaguaagagaugagauagagguagacagacuaacacaaaauugagaauuuagaauugauaguaggacuuggugauuaaccagaugugcgaaguaaaacagcggaaggggucaaaaauaaaucuuaaaaguuucuggcuuggauauguguauggauuuaauuagaaauagggaacucuggaagaggaaucaaucugagugguucaggagguaggaaaggagagaaaauuagcucgcuuaugacacaaggauauuucacuggcacaaaaacaaacagagaggucuagugggcaacuagauauauggaggucaagucagaggucugaacugaagacagagauuuggaauaaucagcauauauguggaaacaaagcuauaagaguuaaucaagccgccaugugcagcugccauacgcugagugugaagaguagagaauccaggaccaacaauuaagagagacacagagaaagggaaaauacuguuauuaugaaacaaguagauggacuuauuuuuaaaaaacagguuuuuauagcacaagaauuaagaugaggauuuuuaaaagaagauaacaucgcagugacagaagaaagauaggaaggagaauacagaaguugauugucauuaacuacuaaauugccacuauugccacaaaauaagcuaauacaggcucaguacuaaucugaaaugcuuaggaccagaaguguuuuggguuuuggaauacuugcauuauauuuaucugaagugcuccaaugaacacuuccuucaaguaacauauuggagcuucaacaguuugagauuuuggggcaauuuugauucugaauuuucagauuuggagugcucaaccuguagaacauacaucugccaugcccauaaaaugaguaauauucacagauauuugcucugguaaggguuuuagcuuaaaacucauuugaaaauagucauuuguuaguuaaaacuaaacagugaagacucaauucucuaaauuaucuuucuauaauuuuacauauaagucuaguuaaccuuuuaaauuaaauuagauucaauucuaguuacuaaaauaauaaguaaaucuuuacuaguuagggacauaauauacagaacuacauuaagaaucuuauaaacagguuaacagaauaaauuuuuugaaugcuguaccucugacuaaggaaacacauuuacuuuaugaauuccuccagacaauuucuuucaguagaaaauauuccgcaaucaucauuuucauuuauacagucacauuauagaaaccuggaucaugacauucuucuaaaaaauuugccaauugagcuguuacucaaaugauuugaaccuuauaaucaucacuauuuucauucucaaugccuagagcuuugggucaugaucagaaaauguagagcuuuaggguuuuuaaacauaguaauuccccccaaaaaaccagcuagacgaucauacaguauuucuuuuauagaagaaaaagagacucagaauguuagauauuuccccaaaguuauucccugagccagugcuaaaaauuagguaaguaacuguaaagaagcaacugauaagcacagaucauuugcacuccauuuauuaauaaacuucaauauaauuuuuuaagucuagaaaaucuaaggagggaaacuuaauuuugaaauugauaauaagcauucuuucugcauaaauagcuuuaaaaacuagauuaugcauuuuuuacagaggacuuaauaucuuaauauuaaauacuaagccuccagagacaucugguauuuguaauuauaaacuuauccaauuaagauuucagcaaaauacauguaggauuuaacuuucagguuucaauauauuuguauauauauuugauuaauauacaacggauuucaaacuagaagcaaaacuauuaaaaaccaucacugaaauacuuacaauuuuguauguguauauuauugauggcagcgguagccugucuggaguggcugcugcaaagacacuggcugcagcaggggagguguggccagagcuacacacuccaugaagcuggcaggauccgggaacagguggaagacccuuccucucccaaguuggaagggaaagagccccacccuccugggcgcagcuguucagcugcggcugcagacccgggcaucccugcgcucuugggggccugggaagcuccacugccccgcaggcucagaagugccugcuccugccgcccacuccaauuucagagcaaaguugugggccgaguccaggcauuguuguaaccuggcuggguaugcauguauagugcugacacuccagcccccugccaccuuggcccccuccagacuuugggcacugacgagcauaggagggaggccaagggcagcauaaggguagccuggugcaggcaccccuuggcaugaauagccugggugccauggaugacaugaagccccaccuucaagccagggacagcuugaagacucaacucagccagggggcugacuugucaguuccagauggagucuaccacccagaaugagagguuauggugcuuuuucugggccugccaauggcccagucagcacacacuuccucccuucugaguccauaaaaacccuugacucagccagacucaaacagacauugggacuaccagcugcgguaaggagcuacccaauucaggucuccucgacucauugggaugacaugccugcaaauaagagcuacucacuccgggucuccccuccauggaggguuacacucaggacugccugccuacagaaacaaguuaccaacucugggucuccucuccgcugagagcuggacacuugucaggacaaccugccugcagagaagcuaccacuugggucuccugagagcuguucugucacucaauaaagcucuucuccaccuugcccacccuccagcugucuguguacauuuuuccuggauacgggaaaagaacuagggacccacccaaugacaggacugaaagagcugaacaaaacaggaggcugaaauggcccccuaccccgcuugacacauugcgggcaacaaggagagaagagcugcggcccuuggggagcccagaccaauuggcucccugagccaaggcugugaaacccucuuuggggcucugugguuucuggugucuccaugcuuccaggcaccacugcauuccccuuguucagacauggaugcccacagcggaagcugcuugugguacacuggauccagcagcaggcuugucuggagcugcaugccccgccacagcagcuggcacgccuggcugugugcaguggccggaccccauguucacucacacaccccuugccacucugcaccuggcuugcccuuggcaggcaugggaucugggcugguagcacaagcugauaacaaccugccaggcugagucagcagaaugagcccagugggcucaagcaaaacuuggacaaaggcaccaccagccauaggaauuucuggcuggaaaagugacagccuaaggauccaaagacauuauguuaaaaagacauuuccagguguaguagcucacgccuguaaucccagcacuuugggaggccgaggcaggaggaucaugaggucaggagaucgagaucauccuggccaacauggugaaaccccaucucuacuaaauauaaaaaaauuagcugggugugguggcacgugccuguaaucccagcuacucaggaggcugaggcaggagaauagccugaaucagggagucggagguugcagugagcugagaucaagccacugcacuccagccugccaacagagcaagacucugucuugaaaaacaaccaacgaaccaaccaaccaacaacaacaaaaaauuuaacuuccuccuuuacuacuguaacaucuuuuuuuaaaaaaaaaaaaaaaaaaaagaaaaggacauuuaacuuccuccuuuacuaguguaacaucuuuugcucacuaggaucaccuccaauauuaaaaaguccaagaaaauaaaaagaaugugaaaacugaacagaaaugaacugcuaacuuaaaacaaaaacuccuaaaccagagagcauuaaagaggauauuaaaaaaucacguuuaaacuguuauaaacugaacuagcaaaaaaagcauuaauaucuaauucaguccuuuuuauuagauaauuuccuauugucaugcaguauauuacucuuugucacaaaucuuuuaagaauauguccaauauuuuauaucuuaaggcagaauggagauaaggccuauaguaagacucuuggauuggcagugaccaucuaauauguuuuguacucuuuccuuuggcugacugccacuacuccuuccccucuuccuuuuuuccaguuaacaaucucaaguagauuguuauaaaaacaugacccugcuauucuaaauauguccuuccauccuuuccauccuucuuuccuuuugucugucucuuccauucuuucaccugagaagcauguguuaaagccccuccuucaauaacuacauauaucaaguauaucuugaguacuaaagaacucaaauugguaaauacuuaauauccccaaacagauaauucuaaaaaacaauagcaaaaaaggaaauaaagaaaugauucuauucacagcuaugucuuaguugccaagaagcuuaaagucaaaacuguauuccuauuuauagcaaggguaauggacauaaauggcagaugaggaugaguuucuuuucucaaacugacuacugguaaugcuucuuagagcacugugcauaaagcauucuuaggccaagcccaggcucuguaggaaugauccuaugauaaauuaccuauauuuaucauagauuuuggaaaguaugaugaugacaugcaugccauacuucugccauggcaaguacuagaauuucgcagaaugcauuuuacuuuucugacuucccacuauuuuccuucuauuuuacaaauucgcuuuuccuuguuguauuuuauguauccauuagaaaugcacacuaauacaaugguguauuagucuguucucaugcugcugauaaagacauaccccagaugggucaauuuauaaaggaaauagguuuaauugacucacaauucagcauggcuggggaggccucaggaaacacaaucauagcagaaggagaagcaaacacguccuuccucacaugguggcagcaaggagaagugcagagcaaggaguuuuauaagcccauuaauaaaaccaucagaucuugugagaacucacucacuauccugagaacagcagcauggggguaauugccccauuauucaauuaccuuccaccggguccuucccacaacauguggggauuauaggaacuagaauucaagaugagauuuggguggggacaaugccagaucacaucauuuuaccccagccccucccaaaugucauguccucacauuucaagacaccaucaugccuucccuacaguuccucgaagucuuaacucauucuguuauuaacccaaaaguccaaguccaaggucucaucugagacaaggcaagucccuucugccuacgagcuuguaaaauaaaugcaaguuaguuacuuccuagauacaauggggguacaggcacuggguaaauacacccauuccaaaugggagaaauuggccaaaacaaaggggcuacagguuccauauaaguccgaaauccaauagggcagucauuaaaccuccaaguuccaaaaugaucuccuuggacuccaugucucacauccaggucaugcugcugcaagagguagccucccacagccuugggcagcuccaccccuguggcuuugcaggguacagccccucuccuggcugcuuucacaggcugguguugagugucuguggcuuuuccaggugcacaaugcaagcugcugguggaucuaaccauucuaggaucuggaggaugguggcucucuuccuaaaacucugcuaggcagugccccaguagggacucuguguggagguuccaagaccacauuucccuuccacacugcccuagcagagguucuccaugaggguuccaccccugcagaaaacuucugccuggacauucagauguuucauacauccucugaaaucuaggcagagguucccaaaccucaauucuucuauucacacacuuuguaugcacccacaggcucaacaccauguggaagccuucaagucuugggacuugcacccucugaagcaauggccugagcuguaccuuggccccuuuuagccacagcuggagcugaagcagcugggaugcagggcaccaugucucaaggcugcacagggcagggggggcccugggaucagcccaugaaaccauuuuuccucccuaggcuucuaggccugugaugagaggggcugcugugaagaucucugaugugcccuggaggcauuuuccccacugucuuggugauucacauuuggcuccucguuaccuaugcaaauuucuguagccagcuugaauuucuccccagaaaacggguuuuucuuuucuaucauaucaucaggcugcaaauuuuccaaacuuuuaugcucugcuuccucuugagcacuuugccacuuagaaauuucuuccaccagauaccuuaaaucaucucucucaaguucaaaguuccacagaucucuggggcaggagcaaaaugcugccagucucuuugcauaggaugagugacccuuacuccaguucccaacuaguuccccaucuccaucugaggccaccucagccucagccuggacuucauuguccauaucaccaccagcauuuuggucaaaaccauuugacaagucuuuaggaaguuccaaacuuucccacaucuuccuaucuucugagcccuucaagucucuuggaaguuccaagcauucccacauuuuacugucuucuucugagcccuccaaacuguucugacgucugccuguuacccaguuccaaaguugcucccacauuuuuggguaucuuuauagcaacaccccacuuucugugguaccaauuuacuguauuaguccauuaucauacuacuaauaaagacauacccgagacuggguaacuuauaaaggaaagagguuuaauugacucacaguucagcauggcugggaaagccucaggaaacuuacaaucaugguggaagggaaagcaaacauguccuuccucaccugguggcagcaaggagaagugcugagcaaaagggggaaaagccccuuauaaaacuaugagaucuugugaaaacucacuugguaucaugagaacaacggcauggggguaaccacccccaugauuuaauuaccucccaccaggucccuucuaugacauguggggauuaugggaacuacaauauaagaugacauuugggugaggacacggccaaaccauaucagaugggaugccauuuuauuccaucauguuaauaaagagugaaaaaaugaaaauacuuaaugcuagugaguuuuggcaaaaugggcauuuauauugcuagagauaauggaauuaguauuaucuuucuggaaaggaauucaguaauauguacaagagcccauuuauacucuucaaccuaaaacuccacuucugggaauccaucccaaagacaugaaaacucaagcacaaagauuuauugcugaaauaaaacagcugugagaaaggaaacaaccuaaauguccaaugaaagaacaauucauauaaagcaagauucuuucuaccauacuguccuucaaaaaagagagcaucagcuuauguuugagccguacaaagucucuaugcuauucagcccucucaauuuuuuuacuuugaacaauaaagacuauuuuggggaaaacuaacacuggccugaaaggacuucauacaguguagcuugguuacuuaccugguaagaaaucacuugauaaacuugguuccaccauaucucccugcccccacacagaggcaaagaaauuuaguaccaauuugguaauuauacauugaaguacagcuuuccaauggcaauuauuggauguuuucuuuaaaagaucauacugggccaggcacagcggcucacuccuguaaucccagcacuuuggaggccgaggaaggcagaucacgaggucagaaguucaagaccagccugggccaacauggugaaaccccaucucuacuaaaaauacaaaaaauuagcugagcaugguggcaugcaccuguaaucccagcuacuugggaggcugaggcagaagaauugcuugaaccaggaccugggaggcagaggcugcaguaagccuagaaugugccacucuacuccagccugggcuacagagcgagacuccaucucaaaauaaauaaauaaauaaaaaauauaagaucauauuauucguuuuuaaaaagaucguauuaaacagccguaucaucaggcaacuagauaaauucuccaauguccuacuggccuuagguuuguuuccaucaccagcaaccaaaguguaacuuaacccccaaauacagauucagucauuaucuaauaaucauguuuauacaaucagucaggaacaagaaaauguuaauucacauuuggaaaugggaaaacugguucagugucuuaaacuucauucuccuggccucacagaaugaguuagaaaguguucccucugauucuguuuucaggaacagauuguagagaacugguauucuuccuuccuuaaaugucugguauauuucaccagugaaaacaucugagccuggugcuuccuguuuuaaaaggcaguuaauuauuucuucaauuucuguaauagauauaggcuuuccauauuaucuauaucuccuugucugaguuuuaguagauuguaucuuucaaggaaccagucuauuucauccaaguuaucaaauauguagucguagaauuguucauaauauuccuuuuuauucuuuuacuauugauggaaucaguaauggugggcucucuuucauuuuugguauuuauuaguaauuuguauccuaucucuuuucguugguuagcuuggcuacaggucuauuaauuuuguugaucuuuucaaaugaaaccuuuugguuucacugauuuucucuauuguuuuucuguuuucaauuucauuaauuucuguucuaauuuuucuuuucuucugcuuagauuuaauuugcucuuacuuuucuaguuuccaaagauagaugcuuauauuauugauuuugcaccuucuuuucuaacgugcauucaaugcuacauauuucccucuaaguacugcugucagaacauacuacaaauuugaugagguauguuuucauuuucaguuaguucaaaaacauuuucuaauucuucugagacuuacuuaucugacccuugugcuauuuagaggugugauguuagaucuacaaauauuuugggacucuucaguucucuguuacugauuucuaguuuaauucuguuguagugugagagaaggcauacucuguauaaugaucuaucuuuuuaaauugguuaagauguguuuuauggccaaauaugguagcauacuuggugaauauuuugaaaaauuauaaauguuuuuaaaaagucagcaaaguaaguauuuugugauaauuacaaauauauguguacacaaugaaggagagguagacacacagcuuuccuaguguuagggaaauggguaauugggguuugggauaaaauuuccaguaaucauguuauacacauauucaaaaagugccauaucuaaauucugagauauagaugacuuaaaggugacuccaguaguaacaaaaauuggguaugcaugaaaucuaagugcaaaaaaguauaucuuuacuaugugaacccuugcuaucugaacccagauaucaaauggcuugaaagauauuuggagauaagccuuagaaaaagauaacucuugauauccgaacuugcuaucuaaacuaaaaaguugaauaguuuuugauaguaaaggauacauaucuuccuauauaauaucugugacuaaaccaguaaauaucugaccuuuauuucaucuacauauuuaaaagugguaugugagguauguauguuugagagagagaaagauuucucuuugggaaacuggaguauuauuugguauuucggaucauuuuauauuuagacacaaacagugguagauuuucaugaugaaauauuaugcaaaacagcauucuaguggcaugggaagagaaguuuacaaaauacuuuaugcaacauagccucuuuuguuuaaauaacaaugccuaguaaaaagacuagaaagaaguguaccuaaauguaaccaggauugagugaucuuuuuucuaugucuauaauaucuguucuauggcaaauuuuucauaccucaauuucauuuguaguuagaaaaauguucaacagugaauuuuaacacaauauaaauaccacaacagaguuauaaagaaaguucaauacugguaucaaagaguaucaauucuuuugggaaguucugagaaaguucuggaagagaacaugcuucaaauauagucuaacauaaaauacaccaauaguuuaucagaauuagaacguaucccauuugcaauugccagaaagugagaacaagcauguaccacacuagaggaauuuaaaauagguccaugugaccagaauacaagcugcaagaauaguggcaggagaaggaagaaugagaauacacacacacacaauggggacugaugcuauauuaaggaguucagaguuuuuagaaugaacaaaaucuaaaccaagccauccagggcuaaaucauuuuaaugcuaaauuucaauacuaaguuaaucccuuccacgauucaagaaacaacuauaaaacuauccuggauaagaucaucaaaaacaacuacuuuagggcucaaacaaaggcaaauaagaugaaaaguguuuauucauaaaaaccaggugaaccuagcuuaggaacagugaggaucuguccuaucuuugccuggagcugcucucaccacccccaaccccugcuuagcuaguaugaaacuuccuccaggacaggacucguuaaaaaauagcagcuucacugcuagaggcggcuaacuugauuuggagcaaaggguaaaaaaccuacacagagcagugucaguaaaagcagcaaacuuggaagaaacaagcauggaaagucagcagcuacgcuagucucaggcuguaguugugguuggguugagcugcagaauggaggacuagucagaaauuuaacaaagauccuggaaaugagauagauauagaggaguuagauaagcuccccacaaagccauggcugauggggaggcuaugugaauaugcagagaaaacccaagagggccuagaagaaaguaaaaggugaggcagauuugaaaagcgccuaaauguuuaaugcacuccccaaucaagacgcacucuacuggaagaggguggaagccuuacugacugagguguuugagcgcaaccucuaaccuaucauuguuuggcuacuaaauuaugcagauacuggugcaaccccuaggaaaucagccuaaaaaauaacaaccccccccaccucugaaaaaaacacuaaacauaauaagggagacagauuccacagauuaagucuaagcaaauuacugagaaacacuacuacuaacgcuuguaggggaaaaaaauccaugacaguuucuauacuuuuuaaccaaaaauuaugagacaugcaaagaaacccggaaaagcauaguccauacucaggggaaaaaaaguaguaaauggacucuugagugagcccaaauguuggguuaaacagacaaaaacuuuaaggcagugauuacaaaauauauauauauuauaaaaauaaaaaaguauacauauauacauauauaugaauacuuuuuuuuuuuuaagacaggguaucacucugucacucaggcuggaguacagugagaggugugaucucuacucacugcaaccuccaccuuccaggcucaagugauccuuucgcuuuagccucccgaguagcuaggaccacaggcacaugccacuacaccuggcuuuuuuguuauuuuuuuguagagacagguuuugucauguuguccaggcugguccugaacuccuggacucaagcaauccaccugucuuggccucucaaagugcugggauuacaggcaugagccaaugugcccagccauaaaaauauuuaacaaauuuaaggaaaucaugcuuaaagaaucaaaggaaaaugcaguaacaaugacucaauaaauaagggaaucucaacaauauaacagagcuauaaaaaauauauagaaaucuaaaguugauauuuuccauacauaucuguguuugauagaaguauaacuauauaauuucuuuaacuggccaacacuuaaaauauuaauauuuaagaauguccauaacacaugaguuaaaggauguuuaguaagucguuaugcauuauaagcuuuguaguaaccuuugaauaaagguaaagauggcuuaugguucccuacugaaguaaucaaagauauuuugauuuuuaaacguaauugcuuaaaacuagguaauauuuucaacaugauuuaaaaucaaagcaaccaaaaguaaugcuuguuauuaucuauaguuuuggaacugcuuaagaguaucuuacuuucauaauuauuuucugugucuaucaagaauauuucuauaacuauucaaguuuagcauuuuuaaguaauuaacaaaauacacuugauaccacaaaccaacaggguaaaaggguauaggaacaauuuuaauauuacagcgaaauaccucagagauacuacagcuuugguuccagacuacugcaauaaagcaaguuacaaaauuuuuuugguuuuccagugcauauaaguuauguuccacuacaccauagucuaugaagugugcaauagcauugucuaaaaaacaauguacagaucuuaauuuuaaaauacuuuauggcuaaaaaaugcuagucaucauuugagccuccagcaaguuguaaucuuuuuacugguggaagcuuugccuugauacucauggcugcugacugauuagcaugaugguugcugaaagcuggggugcuaucagaauuucuaaaaauaagacaacacuaaaguuugccacauacauuggcuguaccuaucaugaaugauuucucugaagcaucagcaugugaugcugcuugacagcauuuuacucacagaauuucuuuuaaaauuggucaguccucucaaacccaaccacugcuuuaucaauuaaauuuuauauaauauucuaaauccuuugucauucuaacaauguucacagcaucuucaccaguagaugccaucucaaaaagacacuuccuuugcucauccauaagaaacgacuccucauccauucaaguuuuaucaugaaauugcagcaauucagucccaucuucaggcuccacuucuaauucuaguuuuucccaccacaucugcaguuauuucauccaugaggcuuggaauaaacuccuccaaacucauauucauguuaauauucugaucugcucccaugaaucacaaauguucuuaauggcaucuagaauggugaguccuuuccagaagguuuuaauggacuuugcccagauccaucagagaaaucgccaugacaacuacagccuuacaaaauguauuucuuaaauaacaugacuugagccaggcucagugacucaugccuguaauccuagcacuuccagaggcugagacgggaggauugcuugaguccagaaauuugagaccugccugggcaauauagggagauucucucucuauaaaaaauuuuaaaaaaguuagcugggcaugguggugcaugcuuguggugccagcuacuggggaggcugaggugggagggucacuugagcccaggaggucaaggcuccugugagcugugaucaugccacuccacuccagccugggcaacagaaugagacccaucuccaaaaaaaaaaaaauaauaauaauaugaccugaaagucuaaauuacuccuugauccaugggcugcagaauggacguuguauuagcaggcacgaaaacaacauucaucuccucguacauauauaucagagcucuugggugaccugguacauuaucaaugggcaguaauauuuugaaaggaauauuuuuuucugaacggcaggucucaacacuaggcuuuaaauauuccguaaacuauucuuuaaacagaugugcugucaucuaggcuuuguuccauuuacagagcacagccagaguagauucagcauaauucuuaaggguccuaggauuuucaaaugguaaauuaacacuggcuucaacguaaagucaccagcugcauuagccccuaacaagagaggcugccuguccucugaagcucugaagccagguauugacuucugaucucuagccaagaaacuccuaaaaggcgccuucuucuuccaauagaaggcuuuuaaaucuacauuaaaaaucaguuguuuacuguagccacuuucaugaauggucuuugguagaucuucuggauaaccugcugcagcuucuaaaucaucacuugcugcuucaccuugcacuuuaugucauggagaugguuucuuagaccucaugaaccaaccucuguuaagcuucaaacuuucuucugaagcuuccucaccucucuuagccuucaauugaagagaguuagacccuugcucuggauuagguauuggcuugagggaaugcugugguugguuucaucuuguauccagaccacucaaacuuucuccacauccacaaucaaguuguuuuacuuucuucucauucccguguucacugaauagcacuuucaauuuuaaaaauaauuuuuccuucacuuugggaggccgagguagguggaucacgaggucaagagauccagaccguccuggccaacauggugaaaccccgucucuacuaaaaacacaaaaauuggcuuggcacaguggcacgcaccuguagucccagcuacucaggaggcugaggcaggagaauggcgugaaccugggaggcggagcuugcagugagcugagaucaugccacugcacgccagccugggcgacagagcgagacuccgucucaaaaauaaaauaaaauacaauaaaauaaaugacuuuuccuuugaauucacaacucaguuaauucuuugguagaaaaggccuagcuuucagccuauaucagcuuuugacaugccuaccuaacuaaguuuaaucacuucuagcuuuugauuuagucagaggagugccucuuuuuacuuguauacuuaaaggccauuguagguuuauuaacuggccaaauuucccuagugucuuauggaauagagaggccugggggugaagggaaagagagagagaagagggggagggggagagggaagaguggggagagaggagaggggagagagacuggggaacaguggauccguggagcaguuagaacauacaugacauuuauugaauaaguucacugucuuauaugguugauaauaaguucacugucuuauauggugccccuaaacaaucuuaauaguaacaucaaagaucacugaucacagaucaccaaaacagacaucauaauaaugaaaaaguuugaaauauugugagaauuacuaaaaugugacaguguauuagugcguuuucaugcugcugauaaagacaucucugagccuggguaauuuauaaagaaaaagagguuuaauggacucacagcuccauguugcuggggaggccucacaaucaugauggaaggcgaaaggcauaucuuacuuacaugguggcaggcaagagagaaugagagccaagcuaaaggggaaacuccuuauaaaaccaucagaucucgugagacuuacucacuaccacgagaacaguaugggggaaaccgcccccaugauucaauuauuucccacaggguccuucccacaacacaugagaauuauuggagcuacaacucaagaugagauuuggguggggacacaauuaaaccauaucacagagccacagugaguacaugcuauugggaaaauggugccaaucgacuugcuugacucaggguugccacaaaccuucaauuuguaaaaaauguaauaucugugaaguacaauaaagcaagcgcaauaaauaaguuaugccuguacuaauaauuaauuggauuauaauagucauguacuuauaaaauuuaugccuauaugcauauaaucuuacuagcaggcagauuuucuuaccaacaauaaaacaaugguaauugguucuauuaauaaccuuucauuauuuuuccuuauuuguaaauucuuaguggauagccacuuuaauuguauuuugcuguuuugauucuuuguuuugauaauuacauaagaauuacauauuguuauauaauuacauauuacauuguacauuauaacuauauaauacuauuauauaacaauuauauguuauauacacacauauagccauaacauauauguaauauauauaauuauguaacaauguauaauuauauaaucguauuuaaugaaccauucuuucucauuuucaguuagaacaacacaugcuacagaaccacuaguuuuccagauagcucuuacaauuuucugcuaguuuuuaaucuaauaauauuaccuaucugcauuucucagucuaucauguaacuacuggaggagcaaguaaacugcucacuguuuaguaugaaccacugcauuauuucacauuaauacaguuauccaggauaaucaaaguagaaaaaguauacuuacucaguuauaaauucaggguuuguaaagcugagguugguuaaaugaccuucaaguugagaagacucaugcauauuuaaggcuggaguggucuuaguggcaaguacagcucuuuuuucaucuuucucaagugcuuuucucuucccaccauuuuggaaauauucucugcauacacuacaaguaaaaauaaaguuguauuuuaacauacuguguacgacuacaaaauaagacggaaaaaauuggcuuuuauuaaucaagaugggaaacuuucaaauuuaagauuucugcuuugaaaaugucaaacugagauaaauuugagcaccuuguagcacuuucaaauuuuuaaaaauuacuauacaauaaagaaugaucacaaauuauguuuaguaaauaaaaaauauguuuuuucaggauuacagauguguuuguauauacuuuacugaacuucucucgacuaaaacuucuccagcaaagcuuacauaacucuacuaugcagugacaacauccagaaggaauaguaguugcaguuaauuuugagcuggcuuuacuaguaguagacagauaacccaacagcuguucuugaggucccucuggguuuaugauaacaaagucagggugagugugcgugcacgcgcgcacgcgcguguguguguuuguauguauguguauauauauguguauauauguauauauggagagcgagcgagcucauuuuucuucuuauuugcacuuaauuuacuacauauagcucauacuuuacacaaagcuauuuuaucauucuccacagacauugcuuggugaaguuccaaaaauacauggcaagagaagaauugaagagcaaagaauucaugcaaaacugguuucagcaaguacaacuaugguccaagggaacuaugcccauuucuccuucaugcuuacaggaucccauuaguucaacuucaguuuuucuuaguuccuauuacuaagacuucuuuaacuuauacuauguagauuuaguuuuaacucuauacgcagaaguugaaacuuauucagcaugaauuaaacauuuauuaaguacgcaucauguguagaggugcauaaugauggccaaauugcagaaggcauaguuguuacccucaagaagcuacuguuaccucaguaaaggacacaaauaauuacuauauauaacaauaaaaaacaugauugauaaacagauaaacaaagauaguuauuucuauaaauaaaguaccuaacccaaucuaaaaucagcaauauaaauggauuuuagaaagauaaguaggaauaaaccaggaaaguaaaguagaguggaaacuuucuaggcagaaaggacagcauaagcaaagacaugaaagagaaaagcagaaugagucuucagagauguaccucaguucaagauacaugaaguuuaaaguacugggcagaagaugaguggaccuauucacaaaugaaaaaacccugagccuagugcacacauaaagaggaaggagagccaagguaugcaagcuucaaaucacacaagauccacaggccaauuuuaaaaugcagucuuuacaaaucuaaucuaaugacagagagcaguuuagagguugccugggauaggguguggggacgagugcaaagggguacaagggagcuuucuggagaaaaauguucuauaucuugauagugguggugguuacauaaguguaaacaacuguaaauacccacuaacuguacacuagaugggugcauuuuauuguauauaaauuauaccucaguaaagcugauaaaaauguagacuuuaucaacuugaaauuaauacuaaaaagcuugcuuauguuucuaucagguagaaccauauaaaacuggugauauucaaaaguucuugagcuacaaaaauugcaauuuuauguggucuaaccuaacagcuacuaaggcaguaaaauacuuaaagggcuaaaauucuagguucucauagaauaaugacaaucaucuaaauuccaauauccccauauacccucaaaaaacauacagaucaauaaagagagcaaauaaaagcacuuaccauuuauaccuauggcauaacaaggaaauaaaaaauaacacuucauuuuacuuguuauugaaaaaauaaaaaucugaaaccgaguuggcuuuggaggccacucaaaguacagagucagaugacgacugcauaaaagagagaaauguaugaaaagguggccaaacagaaucuuccagcaaucacccccuagaccugcaagaauaucaaauugaguaacuauccaugcaaaaaagcaccuucauaagaacuaagucaguuaagagaucacaguuccuacaagaaaagaugcauugaagaugauaggaacuccauagacagucuugaacugucuauaccauccucucccaagccccggcaguacaccccagagagauaaucuuugugcuuugcagagggagugugaaauaacuacgggacuuugcacuggaacuccauguugcccugucacaguggaacacagcacugggcagaaaucuacuggugcccacagggggcauuuagaccauccuugaacagacagaaagaagucugcugcccuagugggaggaaucuuaguccuagucugcuuugcuacuggcugaauaaaguggcccugggcucccaauaaaugucaguggcagccagaccauggcaacuguagucuuugggugagccccagugcugugcuggucucagcagaggcugugagcccaggguacuacaaccaagugugacaccagcugugguggccaugggaaugccuccaucaccccuccccucauucuaggcaguacaguguagagacuucuuccacuuggggcaaggagaggaagaguauaggagacuuugccuugcaacccagguaccagcccagccacaguaaaacaaagcaccaggcagaauccuaaagccccugauuccaggcuguuguucccacauggcacuucuagacccacccugggacagaagggaauccucugcccuggggggauggaccccaagucccugcaggauucauuaccugcugacuaaaguggccuuggaccuucaguaaacaucaaugacaguucaaauaugacccagcaugaggccagcugugguggccacaagagugucugugucacuucuuccccaacucuggucagaccagcauaaacagacacucauuccaccugggggaagaagagggauuuugccugggaacccagcaacuucucccuuaucuucaaguccauuagggcugggaauucagcaaucugcagaaguugcaguguaccugggcuuagagugcccucuagugcugaaaugguuacagugaccacaggcuuagguaauacuuuagauaaacucugaaugcuuagaaggcccucugaaaaaggauggauacuaacaaguccagauuacaaagacuggaauaaauaucuaacucuucuaugcccagacacugaaaaacauccacaagcaucaagaacagucaggaaaaugugaccucaccaaacagacuaaaugaggcaccagugaccaauccuggaguaguacagauauaugacuucucagggaauuccaaauagcuuuuugaggaaucucaaugaacuucaaaaaaacagagaaggaauucauaaaucuuucagggaaauuuaacaaagagauuaaaauaauuuaaagaauccaacaaaaauccuggagcugaaauauucaauuaaugaacaaaaauauguauuacuaucuaaacagaauugaucaagcagaagaaagaauuagcuuaaagacaggcuauuucaaaauacagaaucaggggagaaaaagaaaaaaggagugaaaaagaaagaagaaugcuuacaagucuggaaaauagccucaaaagggcaaaucuaagaguuauuggccuuaaagaggaaguacagagacugggguagaacguuuauucaaaggaauaauaacaguuuuccaaaccuagagaaagauacaaauaugcaguuauaagaucaaagaacaccaagcagcuucaccccaaauaagacuaccuucaaggcauaaaaucaaacucuuauagguuaaggacaaagaaagaauccuaaaagcaguaagagaaaagaaacagguaacaaaugaaggaacuccaauacaucuggcagcacacuucucaguggaaaccuuacaggccaagagggaaugagaugacauauucaaugugcugaaggaaaaaaaaaaaaaaaggaaacaacuuucaacugagaauacuguaccccgcaaagcuauucuucaaacacaaaggagaaauauguagauaaacaaagaugaaggacuucacaccagaccuaccuuaccagaaaugcuaaagagaauuuuucaacuugaaagaaaaggaugcuaacacacaauaagaaaucaucugaaaguauaauauaaaacucacugguaaagguacauacauaguuaaauucagaauacucuaaaacuguaauuguagugcauaaacuauucauauauucagaggaaaaaacccaaugggauaaauuuauuauaucuguacauauauauauauauaaacagauaucuaagaagagauuuguaauaaggaauuggcuuaugugauuaugcagacugaaaugucccacaaucugcuaugccuaagcuguaaaaccaggaaagcuccaauccaaguccaaaggcuugagaacuauuuuauaaguucugguccaaguacaaaaaggcuugagaaccauuuuauaaguuguagucuaaguucaaaggccuaagaaccagaagugucaaugguguagguuccagcuagauggaaggccucaaaagaggccuacucacccacaauagagagggcaaucugcuuuacucagucuacagauucaaauaucaaucucauuuggaaacacccucgcagacacacccagaaauaauguucggccaaauaucugcguaccuuuugaaucaguaaaguugugaauaauauuccauaauaccuaaaauuaacauaggcaacacaauauugacagaaaaacaaacugaaggacuacuaccaacuucaagacuuacuauaaagcuacaguaaucaagacagugugguaauggugaaagaaaagacaaauacaucaauggaacacaauagagagugcaaaaauauaccuacaaaaauauggucaacagaucuuugaaaaaggagcaaaggcaauacaauggagaaaaaagaaaauuuuuucaacaagucaugcuagaacuagacauccacaugcaaaaaaagaaaaaaaguaaaucuagauauagaccuuacaccuuugacaaaaauuaucuugaaaugcaucauaaaugcaaaaugcaaaacuauaaacugucuaaaagguaacauaggagaaaaccuagauggcauuggguauggugaugacuuuuuagacaugacaccaaaggcaugaucuguaaaagaaaaaauugauaagcugaacgucacuaaauuaaaauuuuuugcuuugugaaagacauugucaagagaaugaaaagaaaagccacagacacugagaaaauauuugcaaaucauacauaucagggguccccaacccccaguacugguccgugaccuguuaggaacugggcugcacagcaggagguaaguggcaggugagugagugaagcuucgucuguauuuacagcuguuccccauugcucgcauuacugccuaagcuuugcaccuugucagaucagugacagcacuagauucucauagaagcacgaacccuuauugugaaaugugcaugugagggaucuaggcugcacgcuccuuaugagaaucuaaagccugaugaucugucacuguaucccauauaacccccagaugggacuggcuaauugcaggaaaacaagcucagggcucucacugauucuacauuaugaugaguuguacaauuauuucauuauauauuacaauguacuaauaauagaaauaaagugcacaauaaauguaaugcacuugaaucaccccgaaaccaccugcuuccacuccagucaauggaaaaauugucuuccacaaaaccagucccuagugccaaaaaaguugaggacugcugacauauacaaugaagaacuguuaucuaaaauauagaaagaacucuuaaaacucuguaagaaugcaaauaaauuuaaaaaccagguaaaagaccugaacagacaucucaucaaagaagauacacagaguggaagcaacaagaaugcuuaucaagugcugaugagaaugcaaaauguuacacuuuuuacagcagcuuuauucauaauuaucaaaacuuggaagcaaccaagauacccuuccauagguggauggauaaacugugauacaucuagacaacagaguauuauucagcaguauaaagaaaugagauaucaagccauaaaaagacacagaagaaccuuaaaugcuaauuacuaaguaaaagaagccaaucagaaaaagcuacaaacuuuauaauuccaacuauaugacauucuggaaaaggcaaucuaugaagucaguaaaaaagguggugguugcaggccgggcgugguggcucaugccuguaaucccagcacuuugggaggccgagguggguggaucaccugaggucaggaguuugagaccagccugaccuacauggagaaauccgugucuacuaaauauacaaaauuagccaggcaugguggcgcaugccuguaaucccagcuacuugggaggcugaggcaggaaaauugcuugaaccgggaggcggaggcugcaguggacggagguugcggugagcugagaucgcggcauugcacuccagccugggcaacaagagcaaaacuccgucucaaaaaaaaaaaacaaaaaaaaacaaaaaaaaacaaaaaaaaaaaccaaaaaaguuggugguugcagaugggugaaaaggccggcacaaaggauuuuuagggcaguuaaacuauucuguauaauacuauaauggaggauacaugucauuauacauuuuucaaaaaccauagaauguacaacaucaagaaugaacccuaugguaaacuauggacuuugggugauaaugaucuaucaguauaaguuuaacaacucuaacaaauguaccacucuagugcuggauguugacagugggggaggcuaugcauguuugggauggagugguuguauaugggaacuuucuguacuuucuggucaauuuuauuguggguuucuggucaauuguguuguaaacccacugcucuaaaaaauaaagucuacuuaaaagagaaaacaaaccaaccuugggauaaauauaucauguaucuccugauguauuaaacugagagggacacaacaucaccuaugcaaaacucuugcuaacaauacacuuaacuuauaucuaaucacaaauaaacuacacauauccaaauugagaggcaaucuauaaaauguugacuuuuaaaaaauggccgcauaggccaggcacaguggcucaugccuguaaucccagcacuuugggaggccgaggcaggcagaucaccugaggucaggaguucaagacccgccugaccaacauaguaaaaccccgccucuucuaaaauauaaaaauuagcuggguguaguggcaggugccuguaaucccagcuacucgggaggcugaggcaggagaauugcuuaacccuggaaguggaggcugcagugagcccagaucguaucacugcacuccagccuggguaacaacagcgaaacugucucaaaacaaaaaaaaaaagucguaucauaaaaagacaaaaaagaaaagaaaaaaaugaugaauuuuucuagauuaaagaccaaaaaggcuucacaacuaagugcaaugaguuaucccugaugggauccuggauugaaaaaaaaaaaaauacagguauaaaggacacuauugugaaaauuggggaaauuugauuauggauuacauuauuaguuagcaucacauuaaugcuaaauuucuggagugugauaguuguauuaugauuacguagaagaauguucuuacaugauacacacugaaguauucaggaauaaaagucugguaauuucuguaacugacucucaaaagguucagcagagagcaagagagaaaaaggacccagaggagaaagaggaacaagauacaaaaguaagacuaaguagaguaacauuuuuucagaagcugaaggaaagaaagugugagucaaggauuuucuauccauccaaacuacguaucuuguaacaaaauuauacaaaaccaguuuguaagaugggugaacucagagaacaucauaauuccaaguuguuuuuaaaaaaucuacuggaagauaaacuucaucuaugagaugauuaagaaauguuggugaagaaguagggaauaaaaagcauuaaaucacuuaaaaaaaaaagcggguacuuuaaaaugcuaaaggcauucaauucacuucaauucccagugaagauauaacuauuauaaauaguuauguaucacuuaucauagcagccaucuuuacaaagaagaaauuccaugagauguauggagaaacagacaaacaccaacaacagggacuuuccacuuucaaucaagagaaugaaaagguuacagaagcccuaaaaaacauaauaaaguuuaccuuauugcuagaagaugaacucugcauucagagagaauagcuucuuuuuaauuauacauggaauagucacaaaaauuaccauauauguguauuaagucaugaagaaaaccauaguaaaaaccauaaugaaaaaauacagacaaaauuauacaauugcaaugcaauaaaaugagaauuaaccaaaaacaagaaauccauucuaucugcuauuuuuuaaaaaaguaaaaaaguaaauaacuugggucagagggcaaauacuaauaaaaucacagaauaucuaaaaauaauuaaugaaagcauuacaagucagaagcuaaggaaugcaacuaaaauagcaaucugaugaaaacugagaugcuuuaaugcuuauaucaauacaaacaaaagaagaaaaucaaaugaaauaaacauggaacucaagggauuagaaaaugaagcaaaagaaaggaagagugccaacaaauacacaaaaacuugugcaacuuuuuucuagaaaaauacaccaaauauauagaauagaaaaauuucuuaaacuugacucgguagaaauaaaaaguuuaaacaaaacaaaaauccaaagaugaaauaguuaucagaguuaaucuuaccaaaaagcaccaguacaagccuucaaaaaccagauaaccccuguauuaaucauguuuuuuacuuuaucuuucauauuuugauauuuugggagggguguuggagggugugcuuauacauccagagagagacugccccucucaggaccagcuaauuccuuaaggugguaaacuuacuugggaaaacauuucucauaugcaagccaaccgcuaucuaacuuuuacacauagaccauuaauuccccacuacuaaaucaacucaagaccauauaccagacaacaacggacagccucuaguccccaaagccuacugaaauuauucaaccuagccaauccuaaaccguuuacucugcccugccuuggcuuuuccauaaaaaggucaauaacagcucuggucuaggauuuccuuuagcuccugcuucugacuccugacaaaaucuggugcuuccuuuauagcccugcauggugcaguauguccccuucucucaggaaauauaaguaauaaauaauuauuucaauggcauugaucacuccauguuuucccucagucaccucuauaaauuaaaauuccacugauacaugugagacaaccccaaaaguacuuaaacuguuccaaaccauagaaacaaaaacauuuuuccaaauucauuuucagggagcaaaauuacaauaauacuuaucugaucucauaaagacuacaaaaauaaaggccaauaucacuuauaaauaugaauaaaaauaugaaauuaaauuuuaacaaacagaauuaaauaugaccaagugauauguauuucaggaaugcaaggaugguucagcauaagaaaauccacuaauauaauucacuauauucauaaaucuaagaagaaaacacauuuauucuucuccauagauguugaaaggucauucaacaaaauucaaacccauuccuaauauaaacacucaauaaaauacaaguuggcaaacacuuccuuaauauuagaaauauauauauauacacacaucagccaaaaagccagcaacuuaaugaaaauacaccacauacauuacugcaaaaugaauaaagcacagcuacguaauagacaagagaaaaagauuuagucaaaugaauaagagaggaagaaauaaaacuuuguguauuuauagaugacauaacagauacaccuugacaacccaagagaaucaaucauaaacucauauaaacagaaagaaaauucauuaaaaugguaggauguaaaacauuaaaaaaugaaaaucauccauauauauauguacacacacaacaauauccuguuagaauauagucauguguugcuuaacaauggggauaugucccaagaagugcaucauuaaggugacuucauuauugugaaaucacccaaguauacuuaaaucuagaugguauagccuacuacacaucuacagcauguuaccauacugaauacuguaggccacuguaacacaauuguuaaguauuuguguaucuaaacauagaaaagguauaguaaaaguacaauauuauaaucuuaugggacuaccauuguauguaguccauauauuuccacuguugauggagaugucauuaugcagugcauagcuguauaaacagaagggaaggggacauuuacaacagcaauaaaaaugacaaaauaccuaggaguaagcacaacaagaaaugugcauaaucacuauacagaaaaccuuaaaacacuacuuugcaaaguagucugcuacuuuugacuaaaguagacuagaacaaauggaaagacauaucuuuuuuuuuuuuuugagacagagucuugcucugucaccaggcuggagugcaguggugcgaucuuggcucacugcaaccuccuccgccuccuggguucaagugauucuccugccucagccucccaaguagcugggacuacaggugcacaccaccaugcccagcuaauuuuuguauuuuuaguagggacagggauucaccauguuggccaggauggucucaaucccuugaccuugugaucugcccaccucggccucccaaagugcugggauuauaggcaugagccaccaugcccggccgacguaucuuuuuaauggauaggaugacucaacauuauugagauaucuguuguucccaauuuaugaaaaauuaauguaaucucaauaaaaguaauuuuuaaaauguaguuggaccaguugauccuaaaguacauguggaaaaaagcaaaagcaagaaaaaccaagaaaacccugaaaaagaauagugugagauggggguauggagagaagacacuacagaacagcauuguaagucuuuaugauuaaaauagugauaguaggcauggaucaaugauauacacaauggaauaugacagaaaagcuaaaacaaaaccaacuauaugggaaaacuuaguacaucauguaagugucauaucaaauuacugaagaaaagguaaaguuuuuaauaaauguuggggaaauggauaacuuugguagaaaaaaaauuagaucaauacuucacaagaaagaccaaauuugacuuuuaaacaggucagagauuuaauguaauaaaugagaaauccccuaaguacuagaagaaaacacgagugaauaacaaauuguuauuugaauuccuacagucugguaauuaggaaagcuuuucuaagacaauaaaaaucuggaagcaauaaaacagaagacugauacaucuaacuacacaaaagcaaaaacuuucuguauggcaaaagauauagucaaagacaaagggcacaaauauuuauaaaugauauaaagagcuccaaaaaaaucaagaaaaauuagagaccaaaagucaacagaaaaaaaaaacuaucaaaaacaugaucacauaauucacaggaaaaaaaggcaaaugacuccuaaauauauaaaaagguacuuuaccucauucauaagagaaauguaaaauaaacucaagcuagagauaccaauuccaaucuaucggagaaaaauucaauagcugagccacauacuauguuggugaaguuauagagaaauggguauucuuacuuacuuauuuauuuauuuauuuauuuauuuauuuauuugcuggugaaacugcaaaaugauauaaccucuacacagggcaauuuggcagcacaucuaauaaaaucacauaugcauuuaaucuccauuccugcaauuccacaccuaggaaucuacaaauauacaaugacaaaaauacaaaaugcacacacacaagguuauucauuacagcacuauuuguaguagcaaaagcuuguaaacaagucaugaaaaugaggaauauaucuguauaccugugaugguuaauuuuagguaucaauugucaaacauuaucuuagguguuucuuugaggguguuuuuggaugauauuaacauuuacauugguagacuaaauaaagcagacugccuuuccuuaaugugagugggccucauucagucaguugaugccugaauagaacaaaaaagcugacucucucaugaauaauuaaagagaauuccuccugccugacugccuuugaacugggacaccagcuuuuuccugccuucagacucgaagugggucuagaggcugcuggccuuuagacuggaucuauaccuucagcacucauggauugccaccuugcccacucaccuugcagaucuuaggaguugucaaacucgauaaucauaugcauuaauucuuuauaacaaaucuuacuauacacacaaacagacacauccuauugcuucuguuucucugaagacuccugaccaauaccaaauacaguaauucucauauuaaguaaaaaagaaagguacagaguauauaacaguauacaacacacuaccaccuacagggauaagaaaggguggauauauguacauaugcauauguacauggauaugaauuuguuuauuuuugcaaaaacaaacacugguaggauaaaaacaaaacaaaugaaaaugguuacccauaggagguguuacccgguguaaugccuauaugacaguugaauucugauccugccccaacucugcuuaccuuuaagaaacaggauaccuguaauaaaaaguucccuuugaaauaacgagaccgggugagacugguuagaaccaagauagcugacauaaugaaaagaccucacguuucauuauaaucucauuuccaugcuaaaugaaaugguacucccaccaguuccaugacaguuggcaaaugaccguaacaacugcaagaagccauaaaaggacaaaaaggaugguggcacuccaguucuagaaaguucacugcccauuucuagaaaagacaugaauauuaauccucuugcuuuuaauguccaaugccuucauuagaaaacccuauauuuuaaccccccagccuaucacuaguggagaaguugaauuaugagccaugcuccugcuucucaauuccauggccaucaaauaaagccugcacugcuugauacucacuucugguuuuguguacugguuuugugacaaugaacagggaaagaccccaucuuuugggaaaccagcuuuguugguaacagaggcagguguaaaugaagaaaauaaaagggagucuuuuuugaguauaucuuuuuauaagguuugacuuuugaaccauguaaauguuuuauauucuccaaaauuaaaauaacaauaaaaaacgccccaaacugaaaauuaagugaaaucaacuguauagcaaauugguauuacaaccauacagaaaauaacuguuucaagcaacuuuuaagcauauauucugauccuuggugggauauguucuaaagacaaaagaacugcaaagaaaucuuacauuucaguuauuuuauuuuuagaaaaucaguauugcaauuuuuaaaucauuuuauguaaauuguaggaaaaggcuaauguauuaauguaauucagaaccaaguccuucgguguaacagaagagaaauaaaaaacagauaaguuaagcaaaaauaaauauaaauauaaaacaaaguuguuaagcaaaaaucuuauaauauuaaacuggaguggaaaauaucaauuaggaauuugauugaauauuuauauauaacacuauauaauauuauauuauauauuuuucuaauucucuuuaccaaaaagaugcagaauaaagcacacccugugcacaucuaguauccacauguuacuuuucaaaugccauuucccacuaaaugaaacuaggacucccugaagaaacagucugaugccaggucucgacgaggggaagcaaagacucaucuuuguacuacagagcaagaaagugcucacaggugacguaaaacacagaaguaaacuuugacugggcuccugcugccuaauaugaaauuauuugaacaccccaccccccaaaaaaagacuaauaaugaaaaauggaauaaauaaaaauccaagauguuacugugacaguccaaaaaaauaaaccccacaaccccguuguccuaacuguaauugacuauuauaccaauugcuuucgugaaaauugguaauuaaacagaauuacauauuuuuuaaucugauuuucuggauaacauguaaucaucauucaccauuuauaaaggaaaauucuuuuauuuacaaaagaaugccagcuaauaaaugucaagaaauaauacaauuuuaaaaauaauuguuuuguaaccccaaauauuauuuaauaaauggaaguaaaacuguuuguugaaagacuguuaggaaagaggauugauccacaagccaaaauaucacuguacauauuacuuaauuauaaagggauaacauaaguuuacaauggaaagauugaguagauaccaccuuaaccaaaugauaacauuuaguaucucuaauggcgguacaccucacaacaaaaaccuacuaauaugacacaaaaugauguaugaagcuucaucuaauagauauuuuugcaaaaauaucugaccugaaucaauccuuuagacccaacuuucaguuuacaggaaauaaaugagauugaggaaauaaauaauugguaccaugagaaaacaaucagauaauccugcauguagaacacaaaacuaguuuggaauuaggauacagauuaucagaacagcucauaugauacaauuuaaaaaacaacguauuaaaaagaaaucaugagagaugagaaugcaaaggggucuaaaggaaauaaauuacagacaagcacaaguccuuccaaaaugagaagggaucacaggcacuggggaauuugcugaaaugguaccugggcugcagagaaucaagccuuccaggguagaaauacucugcuggauuaaagggaaauggcagagcuuuuaacaacugcuuggcugugugacagauugauaucuuuaagaaacucaaauguagagauaauucuccccauucuccuccugauucccuccacaggucuauuuaugaguaugugaaggcagcaacagcacugguggcugcgaguggaacuaaaaagcagaaaaacauuaggcuuauguccugcaagagaguugcaccuguaauacucacagaacaggauucauucacuaucaaagcacuugagaccagaagugaauugaaaccaccuaaagaggucauccagcuccaauacagcucaacuccugaugguaucaaaguguucagucuuucauucuagcugccuuucagagcaaaaaaagcaugucucucuggagaaaaaggguauuuaugccaaucucuucuaaacacaaugccaguauaaaaacagaauuaucacacauaaagcaggaaaaaaugacccauaaccaaaagaaaaaauagccaaaagaaacagacccacagauaagacauguuagaauaagcagacaaaaacuuuaaaauaacuauuuuaaauuuauuuuuuuaaaauagagaaaaagacaacccaaauggacaaaaacagagaacuucaacagaaaaauuaaaucucuaaaaagccaaguaacuauuauagaaaaacugggaaaaaugguaucuuaaaaacaucuuuacugguuaaugauagauaaaaaagccaagaaagaaaaaucaguaaagauauauagaauacuugaacaacacuauuaaccagcuugaaccaacaauugcaaaaugcagaaugugggauauucuacaaauuaacugacauuugucuaaaaacucaauguuaugaaacaaacaaacaaaaaaaccaagaaccuaaagaauuguaaccaccaaaugcaauguaugagacuugauuggauuuagaaaaaaauacauauauauauaaauuuuaaaauauauuuugaagacagaaaaaucugaacuuaugaacuaaguauuuuagaaaauuagauuacuguuaacugucuuaauaugaugacgguguugugguuauguagaaaaauuuccuaauucuuaggagaugugugcuaauagauuuagggauaaaauguaauguuaucuguaauuuaccuucaaauaguucaggaaauaguguguuuauaguauauauuucucuguauuuaaagagcuaaaaaaggcaaauuccuuuauugaagguauagcuauaccuguauauugcauuuuuuucucuggcuuuuaaugauucauauuacauauaaaauuuuauuauucuguccuuggcaggauaaugucaguaaggcuuaccucauauaacauauucccauaaguuuuaaguauaacaagaagcaaacuuuuguccaacccuuuuuaaagcccacuuuagcuuucaaacugacaugcuuuuagaauuaucaaaaagagaaaaaaacugcauauagcucauaauuauauauaacucaaguuucaaaacacaauauuguuucaaagucuuuuccccaaaccuaguuuuauguuuaaagauguuacauaacuucucuuaguauuacuucugauaguaaaaaaaaaaauaaagaaauuuaaccauaucuugccacuguucuuuuuuuaacaguaugaccuaaauuccuaaugauuuuucaucaguuuacauaaaaaaugaccucaugugauaauauaacgauugauaaaacaaaaauccaaggaaaaaggaagaagacugaaguuugaggcagauucauuguucaaguagaaggugaaagcaauugcuccaauaagaauacuaccuaucaaaguucauuuaagagauacaguuugagggccugccugcuguacuguaauaguaauuuaaaagcacuacgcuaaaauccaacaaugauggucuuaaacagcaauaguacugauuuccugacuuucuguuacaggggaacuauuugguucaguaguaugccucauuuuguguuucuuaacuugagggagaaaauguauauucuguaaaacagucagauuuauaaccaucuucucucuagaaaugcaaauaaaaacauuuaaccccaaccaucccaucuccuauuauuuuggcaccuuucuuuaguuccuuaacuccauuauucuuugacuccacaauccacugaugguaccacuuucuaacuauaccuuauauuuucaauucccuuacauaucauaaucacuaaaaugugugccccaucaccucccuggcuccucugagucauuacacuuauuugagcauuaauccuaguacacuguccugucaacucacuaucucauucaccaacuguuuaacuauaauuucgugccaugauuauugaaguaguuuucuaacuggguucccuuacugacacccuugcccuuccuauagucuguucuuaacacagaaauuaauucuuaagaauucuugacaucuugcaaaagguuaauaaaauccugucacuucuuuugucaaaacagccauaugacuucccaugucagaguaaaaaucaaugucuuaaaauggcccacaagacccuacaaaaucuagcuguucauugccuuauuuucuaccucucucccucugucauuuugcucuggccacacuggucuccuggcuguuucugaaacaugccagcaugccucuucuucaaggucuucagacuugguagggcuggcuuacugucucauuuccuuuauaucauuggcacacaucacaacagugaaacccucuuccccuaccuuacuuaaaauuguuuuaguuuuccuugcuuuauuuuucucauggugcucaccacugucugcacuaguguaaauuuaaccaacauauuguuuccggccacucaccccaacuagcacguaagcucuaugagagcaaggauuuugugaguuuuauuguacuccuagugccuauaauaugacugguacaaaguagacaaucacuaaauauuauuuauuaaauaaaagaacuaaguuaaauacauauuuuucucugaauuauuuguugaaugaaugaaauaugcauuauuacaguuuuaaaaugagauguaaaaauuuuugaauaaaaauggaaagaaaauguaaaccagaaguuaucauaaacuuacuguccaugagaaagacaaugcuuuauuuuugggaauucauguuuauuuauuuagccucuaguuuuuuuuuuuuuuuuuugguccaggguuacuuuugcagguuuguuauauagguaaauugcacgucacagggguuugguauauagauuauuucaccaccggggcaauaagcauaguacccaaucgggaguuuuucagggaauucauguuuaaguuuagucaauauacuuauccuuucuuauaauuuuaccacauuaagagaacuaguauaagcauuauuucauuuucugauauuuuuagcauuagaaucaauaucaugagaaaauaaacauuauccaaagucaauauaaaugcuggaauacccugaaccguacaucaaaaauucaagauuuaaaaaauuuuaagauguuuuaagacuuuauagaacucacuuuuacuugaaucuaaauaauuaucuaaagaaauuuuuauaccauaauuuauuaaugagucaaguauuaaaucauuauauuuaaauguauuguauguauuaaaugcauuuaaagccauauuuuuuaaaaguuaaaacaaaacaagugugucaaaagcauuuuuauuuaaaaaggugaaugaaacagaccuagggaaagugaagcaaaagggagaaaaguuguuuuaaaagacaugaucucuuucacaguauuucugguauucuauuuuggcacuaugaauuauacacagcaucacuuagauuuaagaguuuuggccaggugcgguggcucacgucuguaauccaagcacuuugggaggcugaggcgggcaggucacgaggucaggaguuugagaccagccuggccaagauggugaaaccccaucucuacuaaaaauacaaaaauagcugggcacaguggugggugccuauaaucccagcuacuugggaggcugaggcagaagaacugauugaacccgggagguggagguugcagugagccgagaucacgccaugcacuccagccugggugacagagcaagacuccgucucaggaaaaaaaaaaaagaaguuacaacaauacauuugaaaccaaaaacguuaauucauaaaaguacuuaccuacaacaccauucaauacgaccuucgcccucacaaguuuuugcccaaugauuaucugccaaauuuuucauugcaacggcauauucacaaagaguuucuucauccucacaguguucucgccagaucuuaucaaaaucucccacuaaaaacaaagugauaaaugaauuaaguuuacacugaaacaugucagacucuugaaauaaguuuuagcacaaucugaaauuauuuaaagauaaauacaagcaaaauuauaaaguaaaaccauaaaauuuuaaacauuuaaaauguuuaaauaaauguuuacacauuuaaauaaauacauuuaaauaaaaauaaaaauguuuaaauaaaaguuccuuuauguaaagggaugcaucauuuuaauuauuuuuaauaaauaaaugaaugauaacagauuugugaagcuggaaaaauugacaacauauacgcagauacuguauauaugaguuaucaguuaauaauccaaagacaugcugguaagaaacaauuacagcugaguacucaagaauuaauuuuccuguuacuguugggcaauauaacuuugcaggagcugaguacaaacacuaaaccugcuucuugacuguuauuuucuugugucucuauugacuguuaucuucuuguauuucuacauuuauuaaaaagggguugguagguaagaugacaauguaaauuaagcaaugaaguaaauauuucuauuuacacacuuggacuugcucuaggcauaauguaguuuaaaaauuuauaauucuaggucaaaaaagucaaaaacugccuugaaggaaauuacuuuggaagccucuccaaaguuuguaagccuuaaaaaauguccuauauaaaaacuauaagcugacuacauuauccauucagcuacuaccuuuuauuuaaauaaaauuaaaucagucaucacaauaugaaauugaaaacaucacugugaugacuaauaaagguaggagaaugcuauugcuaaauaaaggacauuaaugcaacuguaaugguaauagaguaaacaaaauuuacaggguaguuucauucacuguccuuggacauaggaguuagguucuuacaccccauaaggaaauguaggccauuaauuggggacagaauaaacuuaaaacuauaaauagaggggguuggagccaagauggccgaacaggaacagcuccggucuacagcucccagcgugacugaagcagaagacaggugauuucugcauuuccaucugagguaccggguucaucucacuggggagugccagacagugggugcaggacggugggugcagugcaccgugugggagccgaaguggggcgaggcacugccucacuugggaagcgcaaggggucagggaguucccuuuccuagucaaagaaaggggugacggauggcaccuggaaaaucgggucacucccacccuaauacugcgcuuuuccgacgggcuugggaaacggcgcaacaggagauuauaucccacaccugacucggaggguccuacgcccacagagucucgcugauugcuagcacagcagucugagaucaaacugcaaggcggcagcgagacugggggaggggcgcccgccauugcccaggcuugcuuagguaaacaaagcagcagggaagcucgaacuggguggagcccaccacagcucaaggaggccugccugccugccucuguaggcuccaccucugggggcagggcacagacaaacaaaaagacagcaguaaccucugcagacuuaaaugucccugucugacggcuuugaagaagagagcagugguucucccagcacgcagcuggagaucugagaacaggcagacugccuccucaagugggucccugaccccugacccccgagcagccuaccugggaggcaccccccaguaggggcagacugacaccucacacggccggguacuccucugagacaaaacuuccagaggaacgaucagacagcagcauucgcgguucacgaaaaucugcuggucugcagccaccgcugcuccaggcaaacagggucuggaguggaccucuggcaaacuccaacagaccugcagcugaggguccugucuguuagaaagaaaacuaacaaacagaaaggacauccacaccaaaaacccaucuguacaucaccaucaucacagaccaaaaguagauaaaaccacaaagauggggaaaaaacagagcagaaaaacuggaaacucuaaaaagcagagcgccucuccuccuccaaaggaaugcaguuccucaccagcaacggaauaaagcuuggcagagaaugacuuugacaagcugagagaagaaggcuucagacgaucaaacuacuccgagcuaaaggagaaaauucaaaccaaaggcaaagaaguuaaaaacuuugaaaaaaauuuagacaaauguauaacuagaauaaccaauacagagaagugcuuaaaggagcugauggagcugaaagccaaggcucgagaacuacgugaagaaugcagaagccucaggagcugaugcgaucaacuggaagaaaggguaucagugauggaagaugaaaugaaugaaaugaagcgagaagggaaguuuagagaaaaaagaauaaaaagaaaugaacaaagccuccaagaaauaugagacuaugugaaaagaccaaaucuaugucugauugguguaccugaaagugauggggagaauggaaccaaguuggaaaacacucugcaggauauauccaggagaacuuccccaaucuagcaaggcaggccaacguucagauucaggaaauacagagaacgccacaaagauacuccuaaagaagagcaacuccaagacacauaguugucagauucgccaaaguugaaaugaaggaaaaaauguuaaaggcagccagagagaaaggucggguuacccacaaagggaagcccaucagacuaacagcggaucucucggcagaaacucuacaagccagaagagagugggggccuauauucaacauucuuaaagaaaagaauuuucaacccagaauuucauaugcagccaaacuaagcuucauaagugaaggagaaauaaaauacuuuacagacaagcaaaugcugagagauuuugucaccaucaggccugcccuaaaagagcuccugaaggaagcacuaaacauggaaaggaacaaccacuaccagccacugcaaaaucaugccaaauuguaaagacccucaaggcuaggaagaaacugcaucaacuaacgagcaaaauaaccagcuaacaucauaaugacgggaucaaauucacacauaacaauaucaacuuuaaauguaaauggacuaaaugcuccaauuaaaagacacagacuggcaaauuggauaaagagucaagacccaucagugugcuguauucaggaaacccaucucacgugcagagacacacauaggcucaaaauaaagggauggaggaagaucuaccaagcaaauggaaaacuaaaaaaggcagcaggugcaauccuagucucugauaaaacagacuuuaaaccaacaaagaucaaaagagacaaagaaggccauuacauaaugguaaagggaugaauucaacaagaagagcuaacuguccuaaauguauaugcacccaagacaggagcacccagauucauaaagcaaguccugagugaccuacaaagagacuuagacucccacacaauaauaaugggagacuuuaacaccccacugucaacauuaaacagaucaacgagacagaaaguuaacaaagguauccaggaacugaacucagcucugcaccaaguggaccuaauagacaucuacagaacucuccaccccaaaucaacagaauauacauuuuuuucagcaccacaccacaccuauuccaaaauugaccacauacuuggaaguaaagcucuccucagcaaauguaaaagaacagaaauuacaacaaacugucucucagagcacagugcaaucaaacuagaacucaggauuaagaaacucacucaaaaccacucaacuacauggaaacugaacaaccugcuccugaaugacuacuggguacauaaugaaaugaaggcagaaauaaagauguucuuugaaaccaacgagaacaaagauacaacauaccagaaucucugggacacauucaaagcaguguguagagggaaauuuauagcacuaaaugcccacaagagaaagcaggaaagauccaaaauugacacccuaacaucacaauuaaaagaacuagaaaagcuagagcaaacacauucaaaagcuagcagaaggcaagaaauaacuaaaaucagagcagaacugaagaaaauagagacacaaaaaacccuucaaaaaauuaaugaauccaggagcugguuuuuugaaaggaucaacaaaauugauagaccgcuagcaagacuaauaaagaagaaaagagagaagaaucaaauagacgcaauaaaaaaugauaaaggggauaucaccaccgaucccacagaaauacaaacuaccaugagagaauacuacaaacaccucuacgcaaauaaacuagaaaaucuagaagaaauggauaaauuccuggacacauacacccucccaagacuaaaccaggaagaaguugaaacuccaaauagaccaauaacaggcucugaaauuguggcaauaaucaauagcuuaccaaccaaaaagaguccaggaccagauggauucacagccgaauucuaccagagguacaaggaggaacugguaccauuccuucugaaacuauuccaaucaacagaaaaagagggaauccucccuaacucauuuuaugaggccagcaucauccugauaccaaagacuggcagagacacaaccaaaaaagagaauuuuagaccaauauccuugaugaacauugaugcaaaaauccucaauaaaauacuggcaaacugaauccagcagugcaucaaaaagcuuauccgccaugaucaagugggcuucaucccugggaugcaaggcugguucaauacacgcaaaucaauaaauguaauccagcauauaaacagagccaaagacaaaaaccacaugauuaucucaauagaugcagaaaaggccuuugacaaaauucaacaacccuucaugcuaaaaacucucaauaaauuagguauugaugggacauaucucaaaauaauaagagcuaucuaugacaaacccacagccaauaucauacugaaugggcaaaaacuggaagcauucccuuugaaaacuggcacaagacagggaugcccucucucaccacucuuauucaacauaguguuggaaguucuggccagggcaauuaggcaggagaaggaaauaaaggguauucaauuaggaaaagaggaagucaaauugucccuguuugcagaugacaugauuguauaucuagaaaaccccacugucucagcccaaaaucuccuuaagcugauaagcaacuuccgcaaagucucaggauacaaaaucaauguacaaaaaucacaagcauucuuauacaccaauaacagacaaacagccaaaucaugagugaacucccauucacaauugcuucaaagagaauaaaauaccuaggaauccaacuuacaagggacaugaaggaccucuucaaggagaacuacaaaccacugcucaaggaaauaaaagaggauacaaacaaauggaagaacauuccaugcucauggauaggaagaaucaauauggugaaaauggccauauugcccaagguaauuuauagauucaaugccauccccaucaagcuaccaaugacuuccuucacagaauuggaaaaaacuacuuuaaaguucauauggaaccaaaaaagagcccgcaucaccaagucaacccuaagccaaaagaacaaagcuggaggcaucacgcuaccugacuucaaacuauacuacaaggcuacaguaaccaaaacagcaugguaaugguaccaaaacagagauauagaucaauggaacagaacagacgccucagaaauaacgccgcauaucuacaacuaucugaucuuugacaaaccugacaaaaacaagcaauggggaaaggauucccuauuuaauaaauggugcugggaaaacuggcuagccauauguagaaagcugaaacuggaucccuuccuuacaccuuauacaaaaauuaauucaagauggauuaaagacuuaaacguuagaccuaaaaccauaaaaacccuaaaagaaaaccuaggcauuaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaacaggcaaccuacaaaauggaagaaaauuuucgcaaccuacucaucugacaaagggcuaauauccagaaucuacaaugaacucaaacaaauuuacaagaaaaaaacaaacaaccccaucaacaaggacauuaacagacacuucucaaaagaagacauuuaugcagccaaaaaacacaugaaaaaaugcucaccaucacuggccaucagagaaaugcaaaucaaaaccacaaugagauaccaucucacaccacuuagaaugguuaucauuaaaaagucaggaaagccccucccccucucccucucccucucccucucccgcucccgcuccccacggucucccucugaugccgagccgaagcuggacuguacugcugccaucucggcucacugcaaccucccugccugauucuccugcaucagccugccgagugccugcgauuacaggcgcgcgccgccacgccugacugguuuucguauuuuuuugguggagacgggguuucgcuguguuggccgggcuggucuccagcuccuaaccgcgagugauccgucagccucggccucccgaggugccgggauugcagacggagucucauucacucagugcucaauggugcccaggcuggagugcaguggcaugaucucggcuugcuacaaccuccaccucccagcugccugccuuggccucccaaagugccgagauugcagccucugcccagccgccacccugucugggaagugaggagcgucucugccuggccgcccaucgucugggaugugaggagccccucugccuggcugcucagucuggaaagugaggagcgucucugcccggccgccaucccaucuaggaagugaggagcgccucuucccggccgccaucccaucuaggaagugaggagugucucuacccagccgcccaucgucugagauguggggagcgccucugccccgccgccccgucugggaugugaggagcaccucugcccggccaugaccccaucugggaggugaggagcgucucugcccggccgccccgucugagaagugaggagccccuccgcccggcagccgcccugucugagaagugaggagccccuccaccuggcagccacccugucugggagggaggugggggucagcccccgccaggccagccgccccguccgggagggagguggggggucagacccccgcccggccagccaccccguccgggagggaggugggggggucagccccccccccccgggccagccgccccauccgucccuacugggaagugaggagccccucugcccggccaccaccccaucugggagguguacccaacagcucacugagaacaggccaugaugacaauagcgguuuuguggaauagaaaagggggaaagguggggaaaagauugagaaaucggaugguugcuaugucuguguagaaagaaguagacaugggagacuuuucauuuuguucuguacuaagaaaaauucuucugccuugggauccuguugaucuaugaccuuaccccuaacccugugcucucugaaacaugugcuguguccacucaggguuaaauggauuaagggcggugcaagaugugcuuuguuaaacagaugcuugaaggcagcaugcuccuuaagagucaucaccacucccuaaucucaaguacccagggacacaaacacugcggaaggcugcaggguccucugccuaggaaaaccagagaccuuuguucacuuguuuaucugcugaccuucccuccacuauuguccuaugacccugccaaaucccccucugggagaaacacccaagaaugaucaauaaaaaauaaauaaauaaauaaauaaauacucaaaaacaaaaaauaaaaaaaaauuaagucaggaaacaacaggugcuggagaggauguggagaaauaggaacacuuuuacacuauuggugggacuguaaacuaguucaaccauuguggaagucaguguggugauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugacagacuggauuaagaaaauguggcacauauacaccauggaauacuaugccgccauaaaaaaugaugaguucauguccuuuguagggauauggaugaaacuggaaaucaucauucucaguaaacuaucacaagaacaaaaaaccaaacaccgcauauucucacucauaggugggaauugaauaaugagaacacuuggacacaggaaggggaagaucacacucuggggucuguugugggguggcgggaggggggagggauagcauuaggagauauaccuaaugcuaaaggacgaguuaaugggugcagcacaccagcauggcacauguauacauauguaacuaaccugcacauugugcauauguacccuaaaacuuaaaguauaauaauaauaaaaaaaagaaaaaaaacuauaaauagaacagccaaaugugggagauaauuauacuaaaauucuuccuccacuuaagguuauugaauucuuacaucuaagagguuuuuuuuaaacagaaaaggaauuauaauaguccaaauguaacaaccaauauuuaacuauucaaauuugaaaaucuuuccauuaaucccaguuacuggguauuuuagggucuacagucuaauaaguacugaguugaaaaccaaacuauuagcccucuaauuugaucaagaaagaagaguaaggauacaaacaaacccucucacacauuguuaagaugacuauauaucagucugagucuuggccugaauacugauuuuaaaccugagagaauuauuuuugagggggcuauguacucauauacaaauauuuccauuaaucacuaacauuuggguagugacuggccucucaauuuguuacauaucagacuggcaauaacuauuaacuuaaaaaaagcagggaaaaguuuucuagauucucaaauaaaaauuccucaguuuuagaaauguuaagguauucgaguucaaucauguuaaaucauaauaaauuaugauuuauuuuaauauaauggccaauguucuuuuuuuuuuagcaguuugacuugaauuccuauuaauguuuuuuuccagcaguuucauuugaaaaugaccuucugugauaaaauaacuauucauaaaacacaaguccaaggaaaaagaaaaaagggugaaguuugaggcagauucaauguucaaguugaagguauacacaaaugcuccugugagaauaccacauaccgaaguucauuuaagacauacaguuugagggccugccugcuguauuggaauauuaauuuaaacacacuacugcuuuccucaguuuuagcaacaucuuucagauguaguuauuuaucaagucucuaaauagaacuucagaaagugaggcguuugaaacaauacuuuaauuaaugacacuuucauaaacccaugaugguacauaacacuauuucugacuuuauccaucaaauuugaaacuaaaucauucauuaagguauuguauaauuuuaaaggugaaucaucaagucuagaaggccuuuuuuugaacuuuuaaguuucacugcccuauagaaucuauacauuauaaguaaauacauaaauguauuauaugugcuguuaauaggagucauucaaacaaaaguucuaugauaacauauaccugggaaaagcuaugcuuaaaacaaacauauuuucuuuuccuuucugcaagacuuagcgucuaaagaauguacaacuugguugggugugguagcucuugccuguaaucccagcacuuugggaggccaaggccggcagauuaccugaggucaggaguuugagaccauccugacaaacaugguaaaacccugcgucuacuacaaaauacaaaauuagccaggugugguggcgcaugccuguaaucccaacuauucgggaggcugaggcaggagaaucgcuugaaccugggagguggagguugcagugagcugagaucaugccauugcacuccaaccugggugacaagagccaagcucugucucaaaaaaaaaaaaaaaaaaguacaacuuaagacaaagaccuggguccauguaguuuaauugggugagaauccuaggaaacaggaguaaggaaguagagagaaagaugggaaggagaaaaaacuaauacaagguugcuuuacugagguugcugcuguuggcaaacugaaaagcauaccgaauguguccagaauugugcaccuaaagaaugggaggccacggcauuuaucucuaaguucuuauccccauuaacugagaauuauuaacaaucugcacugcuagucugcacuuagccacugaauaaggggacaaucucagugggcuccagcagugugggagaaaggcagaacacaaaaaagcagcacucauuuaaagugggucuauguaagggcuagugaaucugagcucaaagugucuaucuaccaugggugaggacaaagggugugcuaugugaggcaacacaggcaucuguuagaaauucuuagaguccuugccaugucacuauauacuuugaaacucaauuuacucuauaauuauucuacuagcuauaagaugcaaagaacugaaaauacacagaaaccuacuacccuacaacuuuuuagaagaccucuaguuuuucauacucaacaaaauucucugaaauaccaccuaaugaaauuuuauggcuaucuaccucacugaaguccuaaggaagaauucaaacuuuguaggcuaaugcaacucagauuaaccaaacaacuucaauuuaacgauuucauuaacauugaggagucugcagacucucacaaaguguguugacacugaaaauugaugugauucauaaagugaaguauacuuaaauauauaacugacaguagaagaugcaccuguauauauuuuuccuucuuucaacagauuuucuuuuaaaaauacuccauauuaaaugcuacagaaaauaaaguuaaugagcaggcauugguaucaaaaaaaggggagaagacauguaaaauguggaaaugcuauaaaagagauaugaaccugacggguucccuauauccuaugcaaggcauccuggacccaaaacuuuuauuucauauauuuauaaaauaaaaauguuucaaacucugacuacuguguauacauuuuguuaaaagucuggugguuauaaaauugaacaaaaaacauagcuggccuuuaguuaugagaaaauuccacuucccaaaauaccucugaaagcuuaagguaauuuuaaaaauaaaugaaauuauuaaaaaggaaugagaaaaaguauuuucauaauagcccauuuuuuguuuuuauaguauuuaaaauaaugguauuuaaauuuugagcaaaguuuuucaaaguaaucuaugauucagguucuaaaauccaaaaaaaguuaggguucaccagugcccaguauaauauuuaaaacuccucuaccaacucaaacugcauauacaaacaauauauuaaaacucaauuuuaaggauuuuuuuaucacuuaguuauuaggucaacuaauaauuaaaagauauacuauuuaaaaggacaacauuuuuucauuauuaaaagguaaaucaggagcuagaacuucuugaaguuugcaugaaaggucuagucaacacaguauaagaaacauuuaggucuucaaguucuaucagaacucucaaugaauuaauaauuagccuuaugauuuauuuuaauauaauggcaucugugaaugacucaaaaguguuguaauuaauaacccauuuucuuaccaauuucuuauaggcauucuagaaaaaauacaugugucuuaaaguaaaagugagacagagagaaagagagagagaaagagacagguacaaggggaaagggaggcguggagaacaaaaucugcaauggguacacacguuuuacuuugaccaacuacagagaauucacaaauuauuuuuagaaagcacaauucaaaaauauaugcucuacagcuuaaauugucuuacaaaauucuagaacaaaguucacauuaacaugacuucuauuuaguuaucccauaacauuuaaauuuuucaaacacccauuuuaaaaaacaaauucguaauuuuaaacaugagugaugccaacuuaaaguugccaaaccaaguucaauaugauaaucaaugaaccaaauuauuuugaaucuuauaucaagauaauaccauaacuauugcauugacuaaacucaccuucaaaaacacuaugucacaacuaaaaaauaaauuaggagcuacuaauaaaaggacaaugacaacuaggaaagaauagcacauucauuaauuuaaaaagaguuccauuuuuaauaacuuugugauuaagacauuauuacaaugcaacugccuuuguaaaaaaacaaguacaaggaaauggguuuaaaaguauuuuugcucuacauaacauccagaagcgcagcucuaaaacaguuccaaauuaaagugaaccaauggaaucccuaaauuauuuauuuagaguugauauuauucuuucuuuaugaauuaaccucucuccugccaucugguacagcauuuuuuuuccuucaaaauguaacugaauucauauuuucuucaagaggguuuaucugccucccacuuuaucaucuuacacuucccucaucugccauccuuacgguacuuugucauucauuuauacauacugucuauuaaaaccaggugugauuuucccaauagaaaguauaaauggaaaagcaaagacuacuuuugauuuacaauuuguauaaauuagagaaguuaauuagggugcucagucaguggaggacaaaauauuuaaauuuucaucaugcucaaaaaauaaacaugaaaaguauaaacaaauuaaauuaguugcuaagauaaaauucaaacuacagaggauggcuuucaauaaauagcagucacucaaaagcagaauuuaaauuuuucacaauaguuacuguuuucaaaguaagaguuccaaggucagaaaagcaauaauuucaaugucauuuuucuagagaccauuguuuuaagcuuauuaaaaaggcuuuuucauuuuguguuauugucaaaagaaaaccuugcagcugacaguccagucauauccauuaaguucuuuaauagcaguacacagaucuuuucgaaaaauuuauuagcucaaggagaaaugaacaguaacaccaccaaauagauaaagaauuacuuauaugugaaaaaaaugaauagguggugcuaagguucaugcauuuuuacaugccaggaccacuugauuuuuauauacuugauguguauaaaaauaauauuuuuucucaauaacucuauccuaauucuccuuuuuaaaacauacaaagcacagaaaauaaguuagcaaguauauaugugaugccauuuuaagauaaaaauauauuuacaaaccauauaccugauaagggguuaauauccaaaagauauauaaaaaaaaccucaaacugaauagcaaaaaaacaaauaaucugacuaaaaaaugggcaaugaccugaauagauauuuuuccaaagacaacacaaaaaauggccaauggguauauagaagggugcucaacaaaacuaaucaucaggaaaaugcaaauuaaaaccacaauaagauacuaccucccaucuguuaggauggcuauuaucaaaaagaccagagauaacaagcauuggugaggaugugaagaaaagugaauccuguauacuuauguuggguauguaaauuaguacagccaaaacaguauggagguuccuaaaaaaauuaaaaauaaaacuacuacaugauucagcaaucccacuauggguauuuauccaaaggaaaugaaaucaguaugucaaagagauaucugcaauccuauaaucauugcagcauuacucacaauagcuaagaaacgaaaauaaauggaggugaaucuauagugaaaagacaugugagacugagaguauagagagagaccgacugcaaagaaguaugagaaaauuuuggcagugaugaaaauguucuacgccuuauugugguaaugguuuuacagagaugcaugcauugucaaaacuuacggaauuauauacuuuaaaaagacacaauuuacuguacaugaaucauaucucaauaaauuuaauuuuuaaaaaugaugugccacaagcaugguauauguuacaaaauuaagauuauauuucauuaaauuugagggccaucaaauucucuaaaaaagcaaaaaaauacaugaguaucaaaagucuuaaacuuuuagaaauucagaacaauuuauuugauucugacuuaggcauauugccaaauacgggcccuaagaugccuuaucuguagaugacaagacuaccaaauucaaguucaaaguaccuuuaauggucauuuucucuaacacaagguaaguaaagaaacucaugacuaagugcaaacaaguucagcuaccauuucaaggcauuaaaacaaaauguucagaauucagauugucuuacauaguuaagccauacaacgaccagucuucucagcucuugagcaccugauacagugacacaucuaaaagugggauaaaaaacauccaagguguuugguaauuaagagccaaaaaguaaccagaaaacaaaaaguuugaaaaccugcaucuuauagccaacauguuaugaauagucauuucucuaaugugggaagaaaacaccaccaauauucugacaugcuaaaaagguuggacuuuucauauaaaaacuuagaaacacaaacagcaaaaggggcaaaaaaaaaaaaaagaagaaaaagaaaaagucauuuuaauacugagaagacuacagaacagucuagguaaaaauuccaggagccauccagucuuuaaugucauaguccuuaaaugcauugaagcaguauagcuacagauaaaagagcuguuauuuuuaaauuucuguauuuuacaagcuuaguguguuuccuauaugccaaauguuguuuuaagugcuuuucaaauauuaacucauuuaauuauaauaccaauccauugaggcagauauuuuacuuuauagaugaggaaacugaaguagagcgauuaaguaaacuuuuccaagguuacacaacaaaccugguagucaaaagcuaaagucaugcuccuaaccacaaacuuugcuucucuucauaaguuuuuaauucaugaacuuucauggauaugagcaaagcuuugcaacagaggaaaguacacagacucuacuaaccacaaacaaauggucuuuugucagucaaaugcaguuauuuagucucugcaacugcauuauuuguuagauuucuggcagugguucucaacucuggcugccaauucuggcugcacauuggaaucacccagaaguuucauuuaacuggucuggaguggcaacuggucauuuaguuuaacacuccccggaugaauccaacguguagcuauggcuuaaaaccaaugguguauagcaagguugugagcuuaaaagccuggcaaaauaauauagagagcaggggguugggacaaccuuaagaguccaauuuaauuaacaaaaaaaaaaacacaacaaaacaaaucaaugcauggauuaaacuuaauaucuacaaacacuggcucacgguguaucuucuguucuuggaacagccuuuuauuauaaacauaucaacgauaaaaauacuuacuccaaaaugcaagucugugaacacauccuauaaggcagauggaaagaaaucaagaaaaaucauaaccaaugucaccaacauguuauucccuugugaaagugaacuucacaggugggucuaugaccacacagagcacuugcuuaguuuaauuuucaacuuucaaacaaaaggauuuaugaacagccuuuuggaacuuaauuuucauauguucaauuaaaaagucuuacccuaauuucuauauaaauggaaauggauacucacaugcugcucuaaaugcaugaagauuaaccaccuauucuaaaauaaacacagcaauggguauuaguguaucuacacuuaaagcacaauaggucaguauaguuuagugguugucagauguuagauuuuguaacuaguauaaauuucacuucaaauuuaagagacugauauauugggguugaaaaauuuuuaucuguaaauauaaacaaauacacaaaacuauuacuuuuuuuuuuuuuuucuuuuuucgggauggagucucguucugucacccaggcuggagugcaguggugcaaucucggcucacugcaaccuccgccauccagguucaagugauuuuccuaccucagccucacaaguagcugggacuacaggcacaugccaccacacccggcuaauuuuuuguauuuuuaguagagacaggguuucaccaaguuaaccaggauggucucuaucucuugaccucgugauccacccgccucggccucccaaagugcugggauuacaggcaugagccaccguacccagcucacuauuaccauuuuuauuaccaacauacagagagacauacauuauacccacuacaacauccuuaugagaacaaauaaagauaccauaaugaguguaaggauauauuuaccauuauauuuauagaaaaauagaaugcuauucagaauaacuuggaccauuuaaaaaaggguaaaauuaaucuaauauacucaauuuaagaagacaugagcauaaauuagaaaacauggguauccacaaguuaaaauuuuaaaguuaugaauauaaaaagauaaaacucaacuaucuggaaauauuuacauuagcuucuucugugcgugugccuuaaaucuacaaggccuggugcuauguacuaaggcuacagagauaaaaggcagaguuuuacucaagaaacuaaguuuaguagauaaaacagacaaaugaacugguaaguuauaaauaccauaaagguaggcacaaucaugcuauggaagcacaagguaagaggggcacuuagguaggggcacuuacuuauguaggauucugugcuaggugcuguacacaacuguguuuguggggaugggguuugugaugauuaauaaaaacccagaucuuuguuucaagaguuuacauuacaauaaacuggccuaaaagaccaaccacgaagaggucauuucaaaagaggccugaagaucggacucuaaaccauaauccuuaauaaucuagauuuaaaguuguuaaaaacauuaugcugcuaaacuuccaguacaacaguacuucugauuuaaagaggaacauuuuagaaaauuuuacuugaauuggugggggaaggaagaggggcagggauaaugcccaggagccauccaauccuuaaugcuacccugaagacauaaagacagaauagcuacgguuaacaucucuauuauuuuuguuacuuaaggaggguagggauccugcugcuuuugcuaauuagcaaggacuaguaaaaacaggagcuccaaaaguacuguaugauaaaacagcaaagucuccacuuaaucgucaaaugugaacaauguaugagauugcucuaggaaauuaacaaaaauacugaagaagauaugauuauaauaggaacuaugugacaaaugugccugacuuauuuagacacuauagaaauggcuaccaaaagauagaaaacuaauauaaaaaugugucaaaacuaucaaugaagaaauuuaaagacaacuucuuaaagugugccuuaaaaacaaguagcuccuuacacaguggugcagcgagacuaccuauuauugaaaaaucauuaacucauucaguuaucucaacugauguuucacucuguauacuguauuuuuaugacagaaauaaauauuucauaggcacauaugaggaaggaaugaaugugaaaaacaauuugaacucccaggacgagcacauccuuuaguaaaguacccugcuuuucuuugcaacagaaaaaucuuaguucaauguuuucucaaaaaguguuccaaugaucaccugaauuagaaucacaugagggacauuaaauaugcagauuccugggccccaaaucucagauccaccaaauugcuuucuggggaccuaagaaucagcauuuuaaaaaguucacuggaagauucuggagccaacuaacguuuuaagaaccauggccuuagacgcuuuaaagcugcaaacaugauauauacuuauuaaagaaaacaaaugcaccaaaaccaacugaaaauacugauuuguuugauuuugaaagacugggacucuuugaaaaucaaagcaaaucaauauuuucuuaagaaauauuauaguaaacauaauuuuacguuuucuugaggacuuuaggcugucacuaugaacaccuucacucuacuguaaaugaagcauaaauggcggcagauacaguucuacuacuguguugguacccagcacagcagacacccgaucccugggaguacucccuguguucugugaugguuccacuuuucuucuuccaaacucuaacuacugguguguuccaaggaucuguccucaguucuauauuacaaccccacugugcaguuuacuugccucaaagauucagccuccacagagggcuuccaaauccuaaacuuccaaaggauagauugcaaacuaaaucauuaccauuaucccuauaacaagccaaucugccugacuacccuguuccucuugccuccaacuccuaccauuuccaaaguguaugcuaauagcuaucuacauuuucccgggaaagaaauauuggcaucaucuuugacccuucuuuauuuucacugaaacugccuauucugaucuucaaagucugucuucuucuauuuucaucaucacuacuguuauuuaagcuauuauuaacuuuagaucagguuaguauaaaagccuccuuucuccuagauuccuccuacuacaauagcuguguuucugaaccucuuuguccacuguguacucugggagcuuuuauauauacagaugucuguguuccacaaaguuccaaagauuauacugauguggaaccaaggcuaagaaccgcuauguuaguggguuuauuuuccauuaaacaaucaaggaaucugcaacaaugcuuuugguuucuaguguaucuuuucaacugcaaaaagccccuaaaacgauaccuugucacaaagaacacuaauaauaacaaaaucaaauagcuaaacacuaauguacauuguauaccuacaugcccuucauugaacugacuauauaaauggucccuuuaucuuuuacuauuacugauuacugaacucuuuucauuauuuuucuucuguugggaauggcaguucaaacucuccuagugcaaacuuaacaggaccuucugugacaaccuucaccuuauuuauuucaaugaucaggcaaauauucuaucacaaaaagcuuucugauucuauaucagaauaaguauaagaagaacacaaaaagaaaacagcaaaaccucacuugagaaaagaaucuguucaaaguuucuuaaggucuuggacuuggucaaaauuuuaaagcagcuguguuuaaagcccacugaggaaaaaaaauaagaaaaguucaauuaaaaggagucucauucuaauuuuuaaaacaacuucaaaacuuuguuucuggaaaaacaccaacaucacauucauucucuuauuuuuagccuuuuugguuuaaaauuauuuuaauacaaaaguuuuuccccuucccccacaauucucauuuuaaguguuugcugaagaauagucaaucacaaauauauuuuucagcuuauccuacacugccaugcuaauucaccuguuaagaucacccccuaauuccaugacuuuaagaauaccucuuuuaacaguuuaguacauacuuuuacuuuuuuuugugauugauuuauaagcugcagguguuuaugugauaaacuguuuuaaaucuguuugguaugcagaacaaguaaauucagggauugaauaauuugauaaaaugucccaaagauauucauaagauagguuaaaaaaauaaaaacgaaauggaaugaaaaguguacuuuuacuccugacaacugcagccuuuuacauuuucuuggaauuuuuacauaaacgcuuuaaguuuagaaagagaaaugccaggcauaaaagcaaucauuacaggaauggguucaugugaauacgauuauggaaaaaaaaaaucauacaaagacaaccaaaaacacacauggcucuacuucaguucuugauuugauacauauuugucaggcucaucuaauuaaauaaugaagucccuguuugaaaagcgaaacuaguuuuuuuaauuaaaaagcugucuauaacucuuauacauuuaaaauauuuuugguuuacauggaggucaaauuuuaaaaauuauguaugcaaagacagaaaacaccuauaugugcaagcauauuuccauuuauaaauauggaucuauucacuagauagugaaaaaccuaucuuaugaauaucuuaugaauauaaccucacuuuaaaagacugucucuuaacuaucaauggcagacaccagaaauaccccuucgcaucaccacugcuaggcaucucccuaccauuucuuuuuaguaacugcuucagauacgagugcugccuggaacacaccuuuaucuccaguucucacuuuaccuuuagacaaauuggcacagcaucucuuaaguggugaaacaaggcaggccauaaacuggggaaggaaaaagugguaaacgaaaagagugcauuaagccuaccugcuacucuuuacaacccuguucacccuuccccaccccaagccuguucaucaccaucaacuagcaucaguugggcaaaugguuggagaagaguggaaaaaaaucuuuucuuaucacagcaaaaaagaacaacacaacuuauuuucauuguuuuuccuguuuuauuuucaauuccacuaauagagauaagggaaaagaaggcucuguucuccaaccucccagucacuaucuauccuguccuuaauauucaauggcuguuuugccuccuuauucuacccuaacuuauuuccuucccugccaucucuccccaaaaaacccucaccuuguauagccccaacucagcuaaucauaccuauccuauggaucauccauucccaucaauuuauaacuuuucaccuaauggaaauucuagggccacuuccugcuucucauuuucccuccuauucuaacauuuggagucacuaauauuagguuuggaguuggggguggggaaccuauauuauucccauaaaauauguauaguauuaauaaugaacuaccaaagcaucaagaaaguuauuuuaauauuuuuaggacuccgcucacuuaucuguaaaaugaagaagcuauuagaucaccacucuaauaucuggcugacaauuuccaguuccuaauaauagggaucuuaaacuauagaucugagguagaauacaggaauugucuaagaggcacccaguugaaucugcugaucagccauguuugggaaucacugcuaaaugcuaagagguuccuucuagucuaaaacuccaagauccuaagcuggaauuuucacugcauuugcugguagaagaauugugauaaaagggguacaguuuccauaguuauuggugcuauaguucagguauguuauugauucaaugggccuuugcagacugaucuagcacuuaagcaaucuucagauuacaauaacagcugacuugcaaaugaacuuguaaaauauguuuacagacuggggaccaucagcacaauacuaaguccucaaaguaaaacacuaaaaauuauuuccuuaguauuauuaugugcacagaguuuuucacagaugacuuuuuuacuacuaauauuuagccuauaugucagaaauaaagguagaaggagcaugcucauuaggaucacuuauucugcuaauucacugauggggcuuuguauaucauucaagcaaagccuagagaagucuagaucaccggugaaauucaggguauuaaagcgccuaaagaauagucucauucaaauguuuaaacugccaggacuuuaacuccccagaagcauacuagaucauucacuuaugaacuccauguaucuauucuagaucugguaacuuccgauucucauaaacaagaguuccugugguuaauacucaggcuuaaaacaugguuaaacaugugggaacuaagcacauauaaacagcacuugaagagaugccacauuaguguguuaauuugaguggaaccuauucauuuaugaauaaaugaauaaugaaauuauuaaaagguaaaaauagaaauggaauucuaugcuagucauuuuucucuuuagaaagaugcacuuaaauuuguacaaaauagcaggauaaauugcaggaaaauguguccauuuauuuccuaaucucuccaaauaacauaaaaucuacagugaauuccauuauguaagagcauucuuugaauaucaagaaugaugcaguuguugcuaugguaacuacucauuuuauugacuaaauuguggguuuggguagcauucuuucaaaaaacauauuuuaccauccuaaguaggucugauaagacucuuucuauugcuaucuguuaaacaauaacuacaagccccauuuggggaugauuaaacagccucuauuaaaagcuaagcuugauuugcuaaggaaagaaaccuuuaaaguuugaaaaaugaaacauaucaacuacauucaaaagaacaaaggauacuuaguuuuaacuuucuagaguaguugaaacguguguauaaaucaacaguaacaugaucuuaccugucuguauuccuucacugccauaauuuuccuucuaauccuaaauuauuaacuaaguauaggacuaacaccagaaggcugcugacuuuucaguuugcaauuaagcuaaaaugagaaccaguggaaagcuuuccucauuucgauacucaggagaagucucucucccaagccuaugaaaacagaauuuucacugucaaaaucuuauaaaacagcuguguacaaaagccuauauuuaaagauaucaaggauaacuguagacuccaacuauaaacacucuucaggcacaggcaaaagccacuaaggcuucuuccccuaugagcuuccacagaggggguucucaccggaaccccauccauggaagccgagggugggcuuuaucggcaggugucuuuaggaggcuuccaauacaaacgguauuuucagaaccugcccagaucucuuccucaucgccuaaauaaacaguuaagaccaaguauuuaagaaaugggagugggggccacgaguguagcccgcccccuuuuaacaaugugaaguccagucagcuaaaaggccugcuggcuucccagcccuggaagccaaugcgaggaaggcucggcaugguuguaggaaugaaguacuaggaagggggucugauaaggaagcaaaugguacagccgguaggucaagcguaaaggagggacaacucagguuucuuuucgucuuuuacaaauggauuuuaccugucuuguuuuaccucggcgucucuugcaaaaagcgacccccaccuccucugugagcguguauguguuugugugugccgagacaacaaccucagcaccccggcuggggacaggggcuuggaggggguggggacucaauuccuuuacaggccuagaacucucccgaagggcccucaaagaaaagggggcggggaggagcgcgucugaugccgacuagggggcucagaccaggcccgggagagcagcagcggcuggggggacgugcagauccuuuacauuuuaaugguggccucuuuggaggagggaagaggugacaagcgguugggggugaugaggccuccccuuccucccucacucagcgcgcuguuuaccuucucgguacuucuugcggagccgccgguggacgcucuucaccacaccggagagcuucuccugcuccaguuuccgcuccugcucccggggcggcggaguguucggggacccggcccucugcgcacgagcaguauuucggccgccggccccuggcuccauaucgcagccgccgccgccgccgccgccccucaggcccccgcagacgcuccccagauggaggaggugggguaggaggagggagcugcggaggcagcagccagaggaggcagaggaaccggagcgacag

SEQ ID NO: 191586 - RNA, 67120 nt, Homo sapiens
ggauugugcggccgccgccgccgcugcgggaggguugggggaggaguugggaguuuagcgcagucgccggagugcgaggacaacgaccauccggcccuagccuggccgggcgggugccgggagcuucccuuucucagcgcggcgcgaagguggcucgccgucagcgccugcuucccucgaccucguccuccuccccgcuccggaggagcugcgagauguggcgccucugacuccacuucuccccgccccugucaccgagagggggaacgagcucucgcccacucgccggaggagacggcccuggacucccaaccccgccggcgaaaccaugagcuccguccagcagcagccgccgccgccgcggagggucaccaacguggggucccuguugcucaccccgcaggagaacgagucccucuucacuuuccucggcaagaaauguguggucaguggacgagacccgcgucgccacccgugacauuaccucacgggcccgggcuugggggccgggaagugggaguggggaaggaggcgggagcggcgcgggccaggccucccgccagccccggccccggccccggccccucgucggcgcccucgcccugcucccagggugcgggccguggcggucgggcgccgccuucccgagcugcuggagaauaagggagugucaccuccgcaggccuguccuccagccuggccgggccucggcccgcgcccuugcugcugguuaaaacuuuauucucaggccacaaggggauuuucuugcaagagccgcuugguccuagaaucugggcccuuguucuagcucucgcuucaccucuuacugcuugaucuggggguacguuccuuaacaaugccagguuugaggaguggauaggucggggaaggaaggugguuuuuaaucucccauuaggauuccaggagggaaugaagucgagugcaagagccugggcucucuucggauuagagagggugcaagaaauguuauugcucuucguuaaagagaaacaagauuuauuucucuagcaaccuugccuaggccugguuucuacucuccuucccacugauuuuuuuuuuccccccauuggugggagggggugcugcucuccccgcagccaugcgcagggaaaccucaaucucugguagcucuuggcuuuuggggccgagaaugauucuuaguuuggugcugugcggccaauuccaaccccagauggccgguugggagcgagcaguucugcugugggaaggggaauguguguuguugacggaagcauucauuacauuggcugcuggcaauucuggggguggggagguucugcucugugguguaggccuugucgggaucauacugcggugacuggguugaagugugguuuguugaaauacuggcuggaucccuuucucuccacuuugcuagcaccugcagaguaugugccacuggaacccagaaaacacggaaauuucaacaaagcaauaccauuuuauaacuccuuuaaguaauauuagguaugccaaaccagauuucaccugcuucuuuaagaaguuaggauuagacaauuucuggaaaguuauuggauucauuguuaacuucauaggaguccacccuuuguaucuugugccauccgguuggagauugaaucguuccauucaauuucagauguguuucauauuucggaauuuagaccuuagagaacauugaguuuccugauuagaaggaugaaacaagaggaguggcucaaaacgagaauuuuggguaacaacuuuaagccccuccccauucacacacacuuuuuucaacaaaugagaaaacugauccagugagcccaagucauacagcaauuuaauaauguaaccagaacuagaaaaccaggacuccucacaccuaguccuaucccauuguacuuugcacuacaucauguuguuuuagaaggguauuuuuuuuuccuguuacugauuuauuucuaaaagugguguuaaagaaauaaccacuuugccuuuuucaccaaaaacuaauuaaaauacaagauucuuaaagcaccacuaauguuugcauaugcucaguuuaggaaaaucuucagcacuuugaauguuaguuaccuccaaugaaaaaaauucaguugcugguuuaguagauuagcuauguaaccuguaucaaaaaggaaguaguugugcuguguucuacauaccagacacauuaacuuuaggcagaaaggacauuacauuuauacacaaguauacuaauuguucugugcuuaccuguaguuuuacugguuucgaaaaauggcagauggggaaaaauacugugauagagaaaaaugauguugcacauugguuaguguaaguggauugcugaauaggcucucaguauucagugcuuaauuucuuuaugccaucuuuuauuaaucaacuguaccuuuugaauuugucauuuaaaaaccacacuuucaguugucugcuuuugugggaugaagucguugcaaauacuaauuucaauauuugaagucccuaguuaauagagagugaaguaagagugauauuuuaauuuuugaaauaaucuuuuccucccuuggcugauuauucagguuguuuuuguccuuuaaaacauuacugaaauauauugucucauaauaaauccagcaguaagauuuacaggucagaccaaauguguuaggcagaaguauacucaguacucagagcucuaccuaagaauucaagaaaugaaacagaagcaguuauagucgaagcucuggaggagcuucauuucuucuuucauucaacaaacauguauugaauaaauguugaggucaaaaucuggaagggcugauacuuguccucagggagcuuacuaggucuaaaaagggaaacguguaaacugauaagucagugcuucagagugauguguaagaggcugcuuuucacaguagaaaaugccuuggcuuuguaacagcaaauguggguucaaacugggggucacuuuggacaaguuucuugagcuuccuauccuagauuugguuuucucaucuguaaaacaaggauacuaucucaugggguaguuguguggauuaagacuguguauaaauauauggaaacuauuuuuauaaagguuuaggggauuaaaggagagaauggugggagagaggaugauuaaaagcuuuuuaaaauggauaacugauuauuuauauuuaaacagguacucccuaggcugaugagagguaugaaacagcuugaaaaguuaggagaccuacuaauaaguuuguuagguuuguuagggagcaaggagggcuucugcuugggcucucagauuuagguaugaauuggaaucauuguggagauuaugagaaaugcauaugccuaggcccaauuccuagauauuacucagaaucacuggaucugaggugaagcuuggacaugucuauuuuuagcaagcuugacagaaaauucuaaaguauaucacaguuugaaaaccacugcuaaaguccacguugucugauaggauaauccuugagcacauuggaaaucuuaauagauuuuucuucaauuuuuggucuauauuuugcaaauugaagcuaaauuaaguuaaaccaaauucuuuuaguacagcauuucucucaccgcugaagauaccaguguacauuucacaacuaagaaggagauacaguuggggaaguauugcacuauuuaauggggacucacaagaucauauuugacuuagaaaauuuucaggggaaagguggaggcaguauagaagguggauugaggauugugagggaaagacaagggaaaucagauaguugauuuauaguauugcaggugaaauaugaugagggccugaauuaagagaguacuuugggaauucaagaacaauuaaagucuccagcagaaauuagucccaguuauauauagaaggugagggaagggaguuucaauaaaggcaggcauuauaaccaccagcagaaaaaguacacagaaacauauuuuuauucucauucgcugcaaauaugccuaaauguuaaugagacucuggauuggugauuggcuucauggaggaggcagaucaucaguaaaucuuuuguuuuaccacaguuucuaaaaauucauuuuguggaaauugagauuucauuguaauacauaaauacaugauauguacuuuuacauaaauaguucugaugccauucauuagcugguaguauuaugaagggagaaugagaagguuauaaacaagauuacuaggucuuauuuuguaguuagaucuguugccuuucauguagugugauucaguuaauuuuauauaaagaguaugugcaguuuugcuaagugaaguucaacauauauaguccugaauaagugagaaacuaaggaauaggaaaaaauaaaacauuaaacuacgucucuacagccauaucugguuuauauggauuggggcugauaauguuauugagcauuaucuuucccugccauacucaccugguuuguuuuuucaagauuuagugauacuuaagccauuuuuauuaaucaaccuuaaucuuuauuuccuuuaacuccucagcacuuguuuuaacuugcuuauuuucuuuaguuuuuuguuuccucacuauauauaauucuuggagauagacuuuaugccuagguagucuucuauaauuuuuguaacuucuggcucccagaucagugaauacuuauugauugauugaauaauuauaauuacucguuuauuuuuuaggagcucauucugcguuucuuauugcuugauuagguuguuaagcccuucaguuucuaaugcacaugguaucuggacuuuagucuucauuuauuaagcgaccgaaaugguuuaguugugcugcugaacuaauauaggugguaacaguugucuaacaguaguuuguuuguguucuaaaucagaccuguuggguagggauucuuacauaggcauacagggaaggauaugcuuagagggaucauuguauugaugauggccugaguaaggcacuguugguggaaaguuuagaccgggaauguauuucaccuugaguaguaaggaaagauaaaaguuaaaauucacuggauuuggaauauacaaagaugagaagauaccuuugucuaguauagaggaaaaagaugagcacaaaaauguaugugacgcagcguagcuguaagcacaagaagagauucagaaaaguccaacaggguuggguuaugaauuuuacuucugguuauucuuagcucuauauauauaauacagggacauuucuuaacuagucucagccuucaugucuagauuuguaaaaugggcuuagucaaggauuucaaagaguaauucaaucauuauggaaaauacuuagaguccaugacacaaaguauucugggaguuuggaggagcauaugaaagaaaguuguuaugaauacuauucagugcucaguuuagauuuccuguuacuggcagggaggauuuagaguaaaauuuucagcucuauauuguauuuguuuugacuuagguaaauuaacaauuuuaaagucaguuaauuauagguguguaaauuaaaaguuaaggagcagcuugaauguaucucuuuggggagugucugggcagccugagccucccuggcugcuaauugaagaggaagaaagggguccugaugaaaaaguuaggaguuccugaauuuuaguccaugcucugcuaccauacauugugaauaugaacaggaauuuuuuuuuuuuuuuuuuuugagacagagucuugcuuugucgccaaggcgggagugcaguggcacgaucucggcucacugcaaccucggccucccagguucaaguuauucuccucccucagccucccaaguagcuggaacuacaggcgugugccacuaccccuggcuaauuuuuguauuuuuaguacagacaggguuucaccaugcuggccaggcuggucucgaacuccugaccucaggugaucuguccgcuucaaccucccaaagugcugggauuacaggugugagccacugugccuggccauuucucccuuccugaacuucacuuuucuaauuugaaaaugaagggucagacaagauaacuccacagucuuuccagcuuuaaugcuuaaucaguuuaacuauucuagauuccagggacucuagcagggaaagaacaggccuaauguuaacucuagcauauauguguuuugcacagccgagacuaauauagcauauaucuaagcagaagguagauaauccugaauuauuucauugaaaauucccauuuuuaauucaccuuuuucuaagcauuguaauuuaauaggcauuucacuuuuaaaacagcagagugaacagaauaaaaaagcauuaguaguagaauuaccaacucuuagcuaacuuagaauuauuauuuguaauuauaauguauuuuuggguuauuagaaacugcuuuuuugguuaagauggaauuauuuuuaagaauuucucuuuuguuaaccaauuccaucuagaauccuaauucuggaugaaauuguauuagugauaugauagguguuacauguuacugcuuauuuuccaauauuaaaaaaaucgguuuuuaguuucagugguagacuuaauaguuauagugaauugacuugguuacuuuagagacugauucaagauugagguuacuguggggauucauuugugugauuaaaauaaucuugguuuucuuaaauuuuuuuguaaugcacuggacaacaugcugaaauuauggcuuauuauauuagugaauuuuguauuccugaaacagcauaccaagagacacuagaaccuuugacagaacuuuucugaaacccaaaugaaugccaaaauuaggcaugcuuuuaagaugcaaagggcuggguuuuaucuuuuacugucuuucuugcuuauucaacuucuguucuugcugugcucuggauauuagaaagcacagcucuugaggaaaagaugugacugggccuuuugaacagugucucuuucaccaaguucugccagucacucuuuggccaucucucuguuguggacaguuguagggauuuuauuuaaaauauacuauuuuuuuaaaaaguuaucuuuuaauguaaaaauuguaucuaugaguaauaucagauuauaaagucuggaaauaaagucuugauuagagagcagguuugauuaggacauucaggauuccucauaacauauagaauuggagcuacuuaagcguuggccaaaguacagaggagccggguucuauuuguuuugcugcugagcaauuccuaccauguguaucaguauucuagucuucuauaguaagauuuuuaaaaagucuuuauaaaaacugguaagagcaaaacuuuccuaaggaaaugcaugcuuguaguaaucucauguauuucacuuuuguccauauucuauagauuuuuuaaauaaauaauauuaauggaaguauaaugguagcccauucuaguuuugaguagaaaaacagauuuuaaaagagcagauaaggguugaacuuuguuauaauuuauucugucuagaagucauagcuuuccuaauagaguucacucuuacucuaaagguucuagaaacaaaaguuuauacauucauagucacaguaauaggauauacauuguuaacuauaaauauaauucuuauaggucaccuagcaucguugauggauucuuggaaacugugacuuuaggugaaacaacacauaaugaaaccaguuuuaccauaggguaauugauauaaacaagagcuaaguuucuguagcauauaucaccaaacuucuaaauaaagacaaaaacacuucuaauauuaauuaaugaaauaaaugugagcuguaacacauuuaagaaagaguaauaaaaacaagauaauuauuuacccaguuacuucacuucagucucagguggcuggagccuauccuggcagcucaggguacaaggcaagaaccaacccuggacaggacaucaucccaucgcagggugcacucauaccuacacccacaacucacucgcacacuugcucauccugggauaauguagacagaccagugaaccuaacaugcacauuuuugggaugugggaggaaauccaaguacccagagaacccaauagacauggggaguaccugcaaacuccacacagacagugaccccagcuugaaaaugauuuucuuuucucaucaaaguuaauaaugggcuggacguggugguucacaccuuuaaucgcagcgcuuugggaggcugaggcaggaagaucacuugaggccaguaguuugccaccagcgugggcaacauagaccuaaucucuacaagaaaaaguagcugguagugguggcccaugucuguagucccaguuacuccagaggcugaggcaggagguucacuugagcccaggaauucaaggaugcaguaagccaugaugagggcauugcacuccagccugggcaacauaggaagaccuggucucuuaaaaacaaaaaaaaaaguuaugaugaaaggacauugaacaaaaugauguugaacaaaaggauguuauuugaggaccugcuguauuaaguauuuaguaauuaggagacauuuggcaugcuuaaccauauucauaaauauaguguaauacaaaauaaaucuuauuuauugcaucuauguuaguagucucagaaguauucgagaguuauacugauauaauagcauauaggagaguaaaacuaauuagaaaacauuauuuucucauaggaguuaaugcacuguagaggaauuguaacccuuuuuuuaaagagaccaaauaauugacuguaauguugaagagguaaauacagaaaagccccucaagaaaaugugaucaaaugaaagauauauauauaaaagauaauauaugagauauaucugacauauguaugagauauauaugucuuaucaaucaacuccuuuacuaauacauaaacugaugcauaaacuagcuagaaacugaaaugauuuuuauuagugaaacguagucaagucuugaggacuuacuaagcacauaacacccucccaguaucuuggaauaugagggagcaguaaggaaaauccagguuuuaccccucaguuauucacuguauagcugaagaagacaaaaauuaugcacaaaaagauauaugcugcaaaccagcauauauauauauauauacacacacacacacacacacacacacacacacacacacauauauaaauguauaaaagauuugaauaauagagaggagagauagguauaucauugugggacuugaauaugaaaaaccuuaaauagccuagagaauugaugucagaaacaagcagcuuaucagguacagaugcucuucuacuuaugauggauuauguccugauaaaccugucguaaguugaaaauguuguagucaaaaaugcauuuaacacaccuaacccaccaaacauuauagcuuagccuagccuuccuuaaaugugcucagaacauuuacaauaaccuacaguugggcaaccugauguaacacaaagcccauuuuauaauaaaguguugaauauuuuacauaauuuguugaauacuguacugaaaguacaaaacuaaaugguugcauggguacucaaaguaugguuucuacugaaugcauauugcuuucgcaccauuguaaagcugaaaaauuguaaguggaaccaucauuaguuggggaguguuuauaucaggaaauguguaaacaaaaguuugggauagaaaauguguauagaauuuuaggaggcauugaggagacugguuggcuagaauugagaaugacauuugcuugggcagauaguggaugguaaguuugaagaguaaauugaggcuagauuuuggaagaccuuugaacuucaagucuuaaggauugaacuuuauucccuagaaaguaaggaaacacuaagauuucuucaagaaauuucaagauaggaaggaucuggagaaagaaaauuggaaauuauuauucauaauagaaauaaggauugaguaauacuuuauuguuuacuaaauuucuuauuuauuaguucagcacaucagaucugacuaagaaaccuggaauuguggcagcuucuagagcaagcuuguccaaccugcggcccaggauggcuuugaagguggcccaauccaaauucauaaacuuucuuaaaacaguuugagauuuuggguuuuuuuuuugcaguuuuuuguuuuuguuuugcucaucaccuaucauugguguuaccguauuuugugugugacucaagacaauucuucuucuuccaauguggcccagggaaaccaaaagauuggacaccccugauguauagcaaaaaaaaggacuaaguccuugauguauguguccauggcagacaccaacaaucacagcauuuuuuccuacugaguucagacaugguuucuaacuaccuguuguauuccuagaggcaaccacuaccaauuguccagguucacgauagaugaaaucuaguugucauuccaaggcuagauaccagaaacgugaagaaaaaauuggcaauauuuaauuggcuugugaauucuggaugacaacaaaaccucauacuauaaauggcuagauaguaggaacuagaacuuuggacucuaguguugauuauugcggcugugggagugggauuagaucugugaaggugucaagcucaagauuacagagggaacagucuagcuaauguuuuacuuggccagcagcauuggaagaggauggcuuuggccaagugcuaaagugcuauucucuuuaauuugcuagaaacaugguauacauauuguucugcaacuuaacuuuuucacuuuuauuaauauauauaaauauauauuuccauguuuauaucuguugcauccuuuuuauuaauauauuacugccuuauaucaaguuauauuuauguguaauuaaccucuauuaauggguguaauaguuuucccuguagacagucucacacuggugaaaacaucuuauuguucaauucauaguuuuuggugaaauugaauaucuuuucauaucaguugaccauuuauauuucuucugugaauugccucuucuuguccuuagaccaauuuucuauuggauuauuuguuuuugucuuagugacuuggaggagcacuuuauauguuaaagauaauaauucuauacuguaguauuuuuugugguuugucauuuaucuuuugacaaguacuugguuuuggucauuguacagguuuaacauuuuuuguaguuaaguggaauaaucuuucuauuaucauaucaaguucccuagcucagaauugcaaaaauauuugcucacauuuuucugguauuuuuaugguuuuauuuugaacauuuaaaucuuuaaucuuucuggaagugaauuuggaaaaggaauguaauagaaauccagcuuuuuauuuuuauaaauggcuaguugucccaacaccauuuauugagcaauuuauuuucucccauaugaaaugcuuuuuuuuuuuuuuuuuuugggagacggagucuugcucugucacccagacuggaguacaguggcgcuaucucugcucacugcaagcuccaccucccaggucaagagauucuccugccucagccuccugaguagcuggaacuacaggcaugcaccaccacgcccagcuaacuuuuguauuuuuaguagagaugggguuucaccuuguuggccaggauggucuugaucucuugaccucguuaucugcccaccuuagccucccagagugcugggauuacaggcgugagccaccgcgccugucugaaaugcugcuuuuauaauuuacuaaauuacaaggaguacguagaccaagcuuuuccaacccguggcccaugggcugcauguggcccaggacgguuuugaauacagcccaaaacaaauucauaaacagucuuaaaacaugauauuuuuuuuugcaauuuuuuaaaaguucaucagcuauuguuaggguuaauguauuuuauguguggcccaaaacaauucuucuuugaauguggcccagggaagccaaaagauuagacagcccuaagucuuagacuuauuuuugaaguuucuucuauuucuuucauuuguuuauuucuuggccaguacacuggauuuuaauuaguguagcuucauaaugaugauacaguuugauaagaguaagucucucauuacucuucaauauuuucuggcuauuuuaauaugcaugugcuuaguguuuuuuucuaaggcuuuauccuuuaccaaaaaacauuuggcuugauuuggaguagcauuggauuuguagauuaauuuuggaagauugacauauugaggcuucccauuggaaagcaagaauuuuuauuuauuauuugucuuguuuucuucugcacuuuuauacuuuucuuauauauacauuacccauuucuuuaacauuuuuuuugaagugcaaaauaauacccagguauuacauaauguaauguaucacauaaugguguuucagucagugauggaccacauaugugauaaggccccauaagauuauaauggagcagaaaaaucccuaucacccagugacguagcccuaccgacuauuaugcuguauuguugccauguauuuuacuucuacaaauguuauaaauuccaugaugcauuuuuauagcuuuugcuguaaagauucaguuaucuuuuagagacauuuaaauaguaagggaaaaaaaccuuauauuuauucacuugguuaucauuucugguacccuuaauucaucugucuaaaucuagguauuucucugguaucauuuucuugcagugagaaggagaaguauuuuuuucuuuccuucuuuuaaaauguuucuuguaaugcaggucuucuacuuauaaauucuuucagguugauauaacuuaaaagucuguauuuuaucccaguucuugaaagaaauuuucucuggguauaaaauuauaaguugauagguuuuucuuucuguucuuuaaagauacugcuccaguaucuucugguuugcauuauuucugacaggaaaucugcuguuguuuuuuucuuuaauuuucuguacauaauguaucuuuuuuucucugacugcuuuucugauuuuucgcuuuauuacuaguuugaagggaucugauuaugaugugccuuugugcaguuuucuuauucuuuaucuugcuggguuuuaacuaaguuuacaucaaguuuggaaacuucagacaugauuuuuucaaguaucuacuucucuuucccuggcccugcguuucagauauauuagacugcuugaaguugucccauaccucacugcuguauagcauuuuuuccucccuguccuccucgucuuccuccuccuccuugcuuuuuccuuuucuguguuucuuucggauagcaguuguugcuaugccuuuaaauucacaaauauuuugucuacaauaucuaaucugccauaaaaaccguccacuguauuuuucauuucagacauuguaguuuucauuucuagaaguuugauuugcguguuuuuuaaauauauguccagucuuugcucuagcuacauuuugaaauauauggacuacagauauaacaauuguucuaauguccugucugcuagcuacauuuuaaaauauauggacuacagauauaacaacuguucuaauguccugucuccuaucaucugagucaguuucuguuuuauuccuauuuucacuaugggucuuuuccuguuuuuuuuuuuuuccugcauuuuuggcaacuuuugauugaaugccagauuuuguaaaauuuaccuugacucuuuuaauaagucuugaauuuuugaugguaagaagcuauuuuuuuuccaugaagucauuuguauaauugcuaauugaucuguuuuaauagcaaccugcucuuuugugugcucuuuacaauaauacuuaaguaaauauuucugaagauacagauaguuuuuuuuaauucccauugaauuuuuuuuuuuuuuuuuggucagacacuugcacuguguauucauuguagucacucuacucuuugcugcugguuuuccucagcugucuuauuauucuugguuguuuguuuauauuuauauuugaaggacugcuugcucaauauagguagcuggcaugcauuuuuuuaaaaaaugaaaucuuauuuuuuagagcaguuuuacauuuacaggaaaauugugcagaaagugcaaaggguugccauauacucugucuccuucccuacucuucaguuucuccuauuaauaauauuuuguauuagguaaauuuguuacaauugaugauccaguauugauacauuauuauuaacuaaaguucauaguugacguuagauuuaagucuuuguauuguacagaucauuggguuuugguuucacaaguacauaacaucauguccaccguuacagugucauaccagaauaguuuaacugcccuacagauacccugcacugcaguuauuccucccgccccucccugcugaaauccuaucacucacugauuuuuuuuuuuuuuuuuuuuuuuacauuuucuauaguguugccuuuuccagcaugucauauaguuggaaucauacaguauguagccuuuauagacuggcucccuguuucuguugcaccacauucacaccagcauuuaguuuuaccaguguuuuggauuuuuaguuauuuuaauaguuuugcuaucauaucucauugcuuuugcaauucccuaaugccauaugauguugaccaucuuuucauaugacuauuugccauuuguauaucuucuuuggugagacguccagguccuuugucagauuuuuuauuggguguguuuaugucuuauugaugagcuuuaagaguuccuuaucuauuucagaaucaauuccuguaucagcuguguguuucacauguauuuuuaucugagucuguggcuugccuuuucuuucuuuuaucagugucuuucacagaaagaaguuuuuaauuuuaaugaaguccauccaguucaucagcuuuuucuuucauggauugaucauguuuuugguauuguaucuaaaaagucaucaccgacccccaggucacccagguuuuguuuuauguucucuucuagaacucuuacaguuuugcaauugacauuuagaucucucauccguuuugaguuaauuucuguguaagucauaaggucagugccuggauuugauuuuuuuuuuuuuuuuuuuuuggcacguggaugucuagcuuuuuaccacuuguugagaagauuauuaucaguucuuuauuggauugccuuugcuccuuugucaaagaucauuugacugcauuuguaugggucuacuucugggccaccagucuauuuugucuauuuguguuugcucucaacaaggccacacugccugauuacugcagcuuuauaguaagucuugaagacagguagugucaguccucugauguuacucuuacucuucagcauuguguugacuauucugagucuuuuuccuuuccauaucuuuccguuuuuugauauccacaaaauaacuaggauuuugacugggauucuauugaaucuauagauccauuuguggaaauugacauuugagcaguauuuuuuuccuaugugaaccugaaauaccucuuguuuaggucaucuuugauuucuuucaucaaaauuuuguagucauauagaucuuauuuauuagauuuauacagagauuuuuuuugguacuaauauagguggugcuguguuuuuaauuucagguguuaauuggucauuccugguacacaggaaagcaguugacuuugcauauuaaccuuguaugcuacaaccuugcuugauauaaaggcuuauugguuuccagaaauuuuuuguuucuuugauucuuuaggauuuucuacauugguaauuaugucaucugcaaacaaagacaguuuuauuuuuuccuucucaaucuguauaccguuuauuguguuacauuagcuagaacuucuagaaggauauggaauaggaguggugagaggaaacauuuuuacuuuguucccaguauuaggggaggaacagucuacuuuuucuccaguaaguaugggguuagcugcagguuauugauggaaaugcuuuaucaaguugaggacguucccugcuauuuuugagauuuuuuuuuauuaugaaugaguaugcuuuuacuguaucuguucauaugaucauuugguuuuucuuuagccuauugauaugauagguuauauuaguugacuuuugaguguugagccaaccuugcauaccuagaauaaauuucacuugguuuugauguuuaauucuuauauauuguuggguucaauuugcuaauauguuguugauuuuuuuuccaucuuuguucaugagagauagugguuugcaauuuuccuuuuuuguuagaucuuuaucugguguugguauuagcuuaaugcuggcuuuacaaaauaguuacgaaguaguccuucugcuucuauuucuggaagagauuucuaucauguauuccucauauguuuaggauaauucaccagugaaaccaucugcuaugguguuuuuugcuuuggaagguuauuaauaauuaauccaauuuuuaaauggucauaggccuauucagauugucuaguuuuuguguaaauuuugauagaucgugucuuuccaggaauuggcccauuuaaucuagauuacuaaaauuuguaggcauagaguuuuucaaaauauuccuuguuagucuuuuaaugucuggaagaucaauagugauagaccucuucuuuuuuuauuuuuauuuuuuauuuuuuauuuuucgagacagagucucgcucuaucacccaggcuggagugcaguggcgcagucucggcucacugcaagcuccgccucccggguucacgccauucuccugccucagccuucugaguagccgggacuacaggcguccgccaccacacccggcuaauuuuuuuuuguauuuuuaguagagacgggguuucaccauguuagccaggauggucuugaucuccugaucucgugaucugccugccuuggccucccaaagugcugggauuacaggugugagccaccgcgccuggccgccuuuucuguuuuuauguuaguaauuugugucuuuucucuuuuuuucuugguuaagcugguuagaagcuugucaguuuuauugacuuucauuucucuguugauuuccuauuuucaguugcauugauuucugcuauaauucuuuuuuucuuuucaucugcuaacuuuggguuuaauuugaucuuccuuuucuaguuucguaaguuagauacuuagguuauugauuuuaaauccuuuuucuuuucuagcacauuucugcuuuuccugcauuguacucauuuucaugaguuacauuuucaucuucauuuaguuuagaauauuuuaaaauuucucuugagacuccuuugacucaugaauuauuuagaaguauguuuagaaauauuuacgaauuuuccugucuguuacugauuuauaguuucauuccauuauggucugagagcauacuuugugugauuucuauucuuuuaaauuuguuaagguguguuuuauggcccaaaauguggucucucuuggugaucguuccauauguguuugagaagaauguguauuguacuguuguuagaugcugcauucuauaaaugucaacuagauccaguugauuggugcugugcaguucaguucuauccuuccugauuuuuugcccacuugucaaucacugauagaggaguguugaagucucuaaguaaaauagaggaucuaucuauauuuguccuuguaguuaugugggcuuuugccucauguauuuugaccuguauuguuagcugcauacauauuacagauuguuaugucuuuuuguauaauugacccuuuuaucauuauguagugucccuuuuuauccuugguauauaugugugcauauauauauguauguauguauauauguguguguauacauacuuacucugaagcauacuuugccugaaauuaauauagcugcuccagcuuucuuucaguuaguguuaucagggucugucuuucucuaucccuuugcuuuuaauuuaucuguguguuuuuauauuuaaaaugggugucuucauugaguacacauggacacaagacaacaacagacacccaggccuacuugagggugggggguaggagaaggaugaagauuuaaaaacuaccagugggauacuaugcugauuaccugggcgacaauuaccuguacaccaaaccccugugacaugcaauuuacccguauaacaaaccugcacauguacucccugaaccuaaaauaaaaauuggaaauaaauaaaauagguuucuuguagacuauauagagucggguuguuauuuuuuaacccauucugacagucuucuuuuaauugguguauuuagaccauucacauacgauuauuggcaguuggauuaauaucaacuguaacuguuuuuguuguccuuagucuuuucuuuuucucccauucuuugguuuuaauugagcauuuuaugugauuccauugucucucuuuuucuaacagcaguuauacuuauguuuacaauuuuuuaagugguugcccuguaguuugcaauauguauguacaacuaaucucaaucuaguaucgaauuauacucuagugcuuugugaauaguggaguacuuuagaacacaauauucccauuuucuuccucccaucccuccccacugucauuaauuuuauuuaucuaaaagcuauaauaacugaauacauugugucuacuguuauuuuaaucaaacuauuuucuaugagaucaauuaaaaagaaaaaaauuauucaccauuuauucguucucuaacaauauuuuuucuguauguauguguauucaaguuucugaccucuaucauuuucucuaaagaacuuuaaacauuuuuugcuaggcguaucaguaacaaauuucuucaauuuucaguugaaaaauuauuucucuuucgaaaauguuugaaggauaauuuugcuggauacagaauguuagguuguuguauuuuuuucuuucaacacuuuaaauauuucacucaacucuuucacuauacucucuccuuguuugcaugauuucugaagagaaguccaauauaauucuuaacuuuuuucuuccacuggagagaaaauuccuccaauaggaauuuuuagguuuauugaaggcacacagaaugaauucuuaauuuuuugagccuuguuucaugcuccuaauuauuauuuuuuuccuauuuuugagaaagaccuaagaaaguuugagaagcuuuuaacuuuauuugauuaaacauacaccggauuaucacaaucucauauuaagggagcucaaaguaaugcucauagaauagucguaacuauugaauuuaacugucagaaauucacuguuagaaaaucuggaaauuagaaauuggcuucauguguacacccacauacguaucuguaggaagacuuauuuuagugcuacauuguagauugauuuuuauguuguuguaucucuuuauuccauaacuuuacaucaaccuguucauuuccaaaaacaagaaucuuccauggaaugcuaggaacaguuuggaguaaucuaaaacauuauguaauacacagcugcgagacuuugaaaaaagcucugauagcagucaggugacuuacuuaaaaaauacugugucuuacucauuaaaaauauagugcugauuauuaaagacuuaguccuucacuguccaguaugguacuugguagccauuagccacaugagcuauugagcaauugaaauguaauuaauucaaauugagauguugaguaagugugaaauacacacuggauuucuaagacuuagugcaaaaaaaaauguaaacuauuucauuuaauauugauuacauguugaaaugguagaauuuuaauauauucaguauauaaaauuuauugaaauuaauuucacuuuugauuuacaaguuggcuacaaaauaauugaaauugguuauuggcuugcauuauauuuccaacagauacuguagacauaggcaguucacagaguaauaaugacgacagugcaaaucaucuauaaaccuuaccacccagaaauaacacuuauuaacauuuuuguccaaauccuccuagguuuugucuuacaugaauuauugaagaaguacacauguauguacuuacucucagcaaacacacacccacaggcacagacauuaaugguuuguuuuuuuguucguucguuuguuuuguuuuguuuuuugagacagagucuccagacgacuaacagcaguuauguauaauggaguugcccaggcuggagugcagugguacgaguucagcucacugcaaacuccgccacccacguucaagcgauucuccugccucagccucccaaguagcugggauuacaggugcucaccacuaccauauuuuuuuguauuuuuaguagagauggggcuucacuguguuggacaggcuggucuugaacuccugaccucgugaucugccugccucggccucccaaagugcugggaucacaggugugagccgcugcgcccggcugacauuaauguuuuauuggaccuuguuucuugucaguagauauauaccauuaucaguggacacauuuauggaaucagcaauuuccuagagauggacaguuguuggguuguuguuuucccuuucuaccuuuuuacucccuaauauagcaggccacacacacaugcucuucaucugucuucaccagacuugaucuauucuuuuaugacaauuucuaagaaauaaguuugcucaguuuuaaauuuaauuuuugccuugccaaauugcauuuuccaauaaucuguaccuuuuauaaugacagucuaguguuuucuuuguaguucuugaaagugcccaguccccagguaauguuaaacaaaugugaguuuuuuuauuuuuuuguauuucauucuguaaaaugcucugaauuuuaaaaugugaucuuucugaaugcuguccaugcuuuuuguaagagucuuagagacaucucacuuugaaaaugaaaguggaugccugagaugaugaauacagcaguauauuuuacaauuaagcuuucuugucucccuuguaaagugagguacauuucuuuucaaauaaagcaaguaagguuacauuaauguuuauuguuuauaagagcuuucuuuccaauuuaucuagcuaccaugaaaugaagugcgucaaacauaagaagucguuaguguuuuuggugguuugcauuaacgcuucaucuuaagauucuuuuuuucacuuaagaaauuacgguauaauuuauguauaauaaaauacacagaucuuaaauauuaacuuugaugaauuuugacaaaugauacagaguaugaccauacccccaaaauaaaguuuagaauguuuguaauaccucaaaaaguuccauugggagucuaaccaguugguuccuuucuaauuccugccucucuccuaucuucguccacccuuugcaaucacuuucugauuucugucaugauggcuuaguuuugucuguuuuguccucuucacucaguauauacguuuuugagauucaucucuguuauuguacacauguucauucuuuuuuuauuagucaacuggucaguguuuaccaugaauuuaccacaauuuguuugucuguucuucuguuaauggauauuugaguuucccguuuuugacuauuaugaauaaggcuccuguguucuuguauaaguuugugugugugugugugugugugugugugugacacauauuuuuauuucuuuugggcaaauagcucaggaauuacauugucacuggaaagauguauguuuauuuuuauaagaaacuuucagauaguucuccaagugguugugcaaucuuugcacuuccaccagcuauguaugagacuucccauugcuccacaucuccaguauuuuauguggucaguccuuuuguuuuuggucauuuugguggauaugaaauggcaucucaguguggcuuuucauuauauuuccuugaugacuaaugguauucuuucacccuuucagugcuuauuggccauucauguaucuuuguuuuuuguguagcacuucaggucuuuugcccauagauuuaguggguugauugcucuuuauuaaugauuuguagggauguuauauauauucuggacacaagauuauuguuagagauacguacuucagauauuuucucccagucuguagcuugccuaauuauuauuauuauuauuauuugagaugaagucucacucugucgcccaggcuggagugcaguggugcauucuuggcucacugcaaccucugccucauggguucaagugauucucuugcuucaaccuccugagcagcugggauuacaggugcgugccaacacacucagcuaauuuaucuauuuugauuagagaugagaguuucaccauguuggccaggcuggucuugaacuccugaccucaaguaauccacccgccuuggccucccaaaguacugggauuacaggcagccaccacaccuggcccuaauuaauuuuuaaugauguuuuuugaugggcaggauuuuuuaguuuuggugaggcuaauguaucuuuuuuuuuucuuuaaccuuuucuagcacauguauuugugguuugagaaaucuuggccuaugccaaggggucacagucacagucuucugcugcuucuaggagcuuugugauucuaacuugagguuuaugauccaucucaaauuuuuuguguuauauaaagugcaaaaaaggucauaugagaugaucauaugaauuuuuucuuuacaguuucauuuuuucccuauguaguuaauuugauacagcaccauuugguaaaaaagccuuaucuuuugucauugaauugacuuggaacccuuuuuaauaauaauugaccuuauauguuugggucuauuucuggagucugaccugucccauucauuuguuuuuccauccuuauauaauauauuauugauaugauuguaauuagaaugauuuuucacauucauaugcaugaagaauauugaucuaaauacuggucuguaacauuaacagaguuaauacuggcuuugcaagaccuuuaaaaaauaugcuuuagaucucuagguaauauuuaacagugaacuuauguuugcuuaaaacacugaucuguuuaucuucuuuucuugugaccaaaauuaacuguuagggauucuuacagacuuaguguugaauaaaaauuuuuaguuuagggaaggaauugaaaucccaccucccccuuccagaagccagugggacauuuaauuuaaauguuuucugcacugagacacaugguucacagcauggggucugcaguaaagcagaucuaaauuuauaacccuguucuuugaguuucuaccucugugacaacgggcaaguuacuaaaucuagcucaauuuuaauuuccucauguaugaacuuaguuccuucuaggauugauauuaaauaagaaaauacaaguaaaguucuuagcacucugccugauacaaguaucaguucuagacaguuguuauauuaauauuuuuauuugggauucuaaugaggaaaaaaacauauuucaagaaauuguuuuuuuuuaaauauaaccuaauguaaauuaaaauagaaauagguuucagaggcauaaauucuguguaaaauuacauguguuuuaauuuuuaucuuugcauacauagcuuuacaguuuucaaauuauaucccuccuuuuuuaaaaaaaacagauuauuagcaucuugaguuuaaaagucuguuccguauuuucauagcacaguagugaugagcauacuuaauauuuauugaguaauuuaauagaacauuaaauuuacauacaguuuguguaccacaauaauguguaaaagauagaacaccaucuguuuuuaagaccgucuugaaaaccacaaaauuguucaguuaaccaaauguacugaaaauuauuucgugcuucuaugcucaucugacuuacagccuuguuguacuuugaaaauuagugggaaaaguacauucuuuuuaaaaauguacguugacuuuaguaugcuguuuuuugccucagaacucucacuacuuccuucuauuggggaagcuuugagaauuagugggaaaaguacauucuuuuuaaaaauguauguugacuuugguaugcuuuuuuuugcccccaaacucucaccacuuccuucuauuggggaagcuguuguagaagcaaauuguuguggcauuuaaaacaguaugaagggggaugcauuaacugagguuuuucaccaugucauauaaauguuuaugauuaguuaugaagugccaagaagaaaagugucaucauucuucuaaaaauaauuucaauaccacagauuagcaguuuguaauguucugaaaaauuguuuaagacaauuuugauagcacagcaguaaucaauacgauucuaagaaaggcaccccucucaguucaauccggcaaaugaauaaaugcaaaacgcauauaaaauacuguguuggaggcuaaagguaauaacaguucaagagcauguggcccuugucuuuagagggugaacaguguuuuggugaagcaaacccuacaugggaacuuauaagucauucaauaagugcuuuauuggauguauaaaugaaauauuaugagaauacagaaagggagaaauauuugcuugaggaaauugaaaaaacuugaucaagugugacauuugaacucuacauauauggaguuugaaaaguuuucaacauuauguuucagcagagugaacacuauaagcugagaaguaugauauguuugggggucugcagauuaauuggcugcuaucucugauauauauuggguucauaacaagauagugucaaaguguugauugccccagacuaagaaauagcuugaauucuugaagaagaguuuggacuuuauuuuuaucaaauaggaaccuguuacguuuucaaauauugaucuguguccuaaaagauaacuggcaagcacuuacgaaagaauaaaguagaggcagugucuccucuugggaagggggagcuauuacaauacuucaggccaaagcaagguauaaauuugagaucucgcuuauauacuuguauauaacagcauauacauauaaugaaaaagugugucauuucucauugaauuucauuaagauuucagagauaugagaauauacacaaucuuuuagaaguguauuguuagcuaagcuucuuuuguacaaauaaaaugaacuaauucuggcuggcucaaccaaaaaggaauuuuuuggcuaccagaggaucccauggaauccaaagcagaauugaacaaggaaguuucaggaacagcaggaagcugggaagcucugagaaaaacagcaggaguuauuggaacuuuucugaacuccaagccucuccuuccuuacuaaacccaucaguccugggucccaguuuagaauucuaaauuccugggagagaaucuuaauuuaauugauugagcuuagcacaagugcuuguuccuggagagaggcaaugagucucuaacacuggaaguauugggguuggggaaugggugguacuggcaagguagguuugucauauguauacaagccagcaaaaauccuauuaaaauguacuacaugauuauuaauuugguuuuucacugaccuaaacuugcuuuagaugccaucguucaaaauauuuacucucuacuguauugaaguguuuuuuuaguuacagcuccaaucugagauuugcacauaguaaaggugugaauguuaucuuucuuauuuuuggaagccugggcuuuuuucagauucucuuuaauugaccaacauacugaaaauaaaagaaauauuagucuuuucauuacuagcuucuguuggcuaguaauagagccuuaaaaugaucugauuagaaauguugcaaugauacaucugauaauaucauaauuagcauuuaauaaugcauacaaugccaguguucuaaguacuuuauguguauuaacccuauaauaaggaacuuuacauguauuaacuaaauaaaguuagucccauuuuauagaugggaaaacagggauaggguaguucaguaauugcuuaaaaccacauugcuaauaagugguggaaucuauucccagagucugugcuuucagucauaacacuauucuucccugggacauuccugauucuuugcccucacuuguguccaguuagcauucagggcucccuucuuagccuucccagaacauuuuuauucuugcuuucauuuugguacuuauacuuuguuauaauuauuauuauuuuuguuguuauuuuuugagacagagucucccucugucacccaggcuggagugcaguggcgaucuuggcucacugcaaccucugccucccagguucaagcaauucucauaccucugggauugcagucacacaccaccacgccuggcugauuuuuguauuuuuaauagaggcgugggguuucgccauguuggccacgcugguguugaacuccuggccucaagugaucuaccugccucagccucccaaugugcuaggauuacaggcgugagccaccauggccagccuacaauuauuuuucuaaacauaucuccuuuuuagguuauuaacaucuuggagacagagaccuucuuuuaaucaucuaagaugauuaagauaauaaauaauuguuaauugaauuaauacccuguucagauuuagucucuagguuagccagacauuuugugaauaaauacgauucuuuaaauuauuuuuauuaggaacauuccuuuguguaguuaucccaacuuugaccuucuguugaccuuauaaauuccauaucuuguucuaauaaauuauuugcaugagauuaucccuaggacuuuccagagcauuauuguccaauagaacuuuuuaugaugcuguccaauaugguagacaucugugauuauugcgcacuugaaauguagcaggugugacuuugagagacaacauuuuuaacauauuugaauagccauuguggcuaguggugaccuuauuaaacaguacagcuccagagagcaaaagcaagaugaguccagaaacuaacaguacccucccgccugccccugcccccacccccaaagccacccagcuuuggagcuuaccuagagaggacaguaacaguguaaaagaucuguguggacucaaagugaaaucauucccaauuaauuuauacauucuaaaaaauagagaacauuuauuaaaucucaaucgcagcucacugcagccucugucuccuggguucaagcauuucucuugccucagccuccugaguagcugggacugggacuacaggcgcccgccaccacgccugaccaaauuuuguguuuuuaguagcgacaggguuucaucauguuggacaugcugguccucaggugauccacucuccuuggccucccaaagugcugaaauuacagaugugagccaccacacccagccuuaagucucuuaaauugugaauaaaauguaaaucuuaaaaacaaaacuugagaaagguucuuggauucuuuggugggguuuuuuguuguuguuguucguuuguuuguuuuuugggguggaugcuaucuagcucuuguguguaauguacaugagagucucaaauguuguacuuuaaguccuuagguuguauguugaauuuaaacuguuacuuguuacaaagcccuuaccuuuaccuuaugccuucaaaagcucauauuuaaauaaaauggcucucaaaguaaccuaccuuuugcacguuuuuugcccaccuugauuguacaugucagucaagcaaacuaaaagugcuuauuuauauaaaguauauguacaucccugugacuguccuuaaaugcuuauuagaucauugaauugcugaauauagaauaacaaauauggaagacaaaaaauuuuaauuugcuuauuuuuauuaaucauguuuaagaguuugaaagacugcaagaguaaguuuguaaaagaaaucaaagacuuuguuguucauuauagacuggcuaucucccuauaguagccagaguuugcuuuuuauuaguuuaagccccuaggcacuguaguauguuauucagcaauguuuauuuuuaauuuuuuagggggaagcuaaagagcuacucaaaauucuugcuagguuacuguuucuaggucagaaagguuauuuuuguuuguuuguuucagacuugcaccauaaugugauuugaguaggucuuuuuuuuuuaacguguauauauuuuaaaucaauuuuuaauuuuuggaaagccaauacauccacaugguuuaaaaaucccacagugugcaggcaccuguagucccagcuaccaggaggcugaggcaggagaauggcaugaacccaggaggcggagcuugcagugagccaagauugugccacuguacuccagccugggcgagagaaugagacuccaucucaaaaaaaaaaaaaaaaaaucccacagugugaaaagaaagugauguuucucauuuauccaguccuucauuugccuagucauuucuucuccaacaaaauaccuguccacacacagaaccuuuaaacaacuguuacuaguuuugucuguucuucagaagguucugugcauacauaggcaaauguaaguuauuuauucuuguuugugguauuguguacagacguuaguauaugcuacccuuacuuuuacaucuugccuuuuauucagauaacaguguaucuuguucaucuuaucauuacuugaauaacaacuuuuuuuuuuuuuuuuugcagcuguaugguauccuauuuguauagcugaacugugcuuuauuuaaugaguguguauuuuucuugaugaccaaaauauucgaguaauuuuggauaauuuuaagauucugaagauuugaauuaaugauuuaaauaaugguuuugauagaagucauuguaaaguguguuaccccuuuacccugguuuaguuaaauagaucaaacacguuacugaacugauuuuaauucuuauaugauaaacugguuguugggaaacagguuuggggguaaccauauauuuugugcuaggugaguauagaaauaagacagggcccuaucuucaaggaguugacagucugcugagaagaccuaagugaacagauuauaauacaguaacugguauaaugaagguuccuaggcacuaugggaacucaauggauaggccuuugucacagacugagggaaagguggguugggagguuccugucacaggugagcagugacuagugacuaucuggcugguggcuugggugguaaaaagaauuuaccaagacaguuguaacuacagaaaggcagauuucuuagagacaguaugaaaauauguugcaagggugcaacagacaggucagcaagagaggagcugacugccaggauacaaaggcuugcuggagauuuuauagaauggugcuugugcucuguacugaagagggcuuugugccauacugauaacaagguugcagugagcuaacuugaauuuuucugucagccaagggucugcugauagcugagcucaggaagaucaugaguuauuugcacagaagggcuauguguccuggaccaugaagaaaggcagacuuacagcuuacugcuuucucuuuuugcuuuccuugggucaucucgccagccugacuucccucccagauuaggacuucacaguucccauaggcaacaucauagcugaaguuugaacagugaccaagugaaaggagagucagagaggguacuucacuuuugggagcauggauuucgacauaaaggaucaggauaugagagagguuaaugacuucuaagacagucccaugugacuucagcauaucaugugguagaugacaaugaggcugcacauuucuuuuuaugaucagaaacauuauuuucccaauauuuugcacugcugaucagaacacauguaaaauauugacuucauuuuaacaagggugaccagacuaauaaagggauucauaaaccaggucagaugaggaaugaucaaaauaaauuuuaccuuaaaaagagaugaugugacaaguagaguuuuaguggaacaucgcuguggaagcgaaaauguugcugccacuacacagaaguaaguaugcuguaacuggaggaugugguauauaccuucgguuuugcauuauuauagcuauaguaccuggcauuaugccugccacauaacaaaugcucaacagauacuugaaugaaagaauaaaaaauacaaaacguguggguggcaauugccaggaaaacagguuuagauuaacuauuuaaaauuuucuaacaguaagauauucuuacugcuuaaacaguaaaauaguuuuuccuucagguugugagcaccccauuacagcaagcauuuaagcaaaugcuauguaaucaucuguuaaaaauauuauauggggcugggcauggugguucaugccuguaaucccagcacuuugggagaccaaggcaggaggaucacuugaggcuaggaguuggagaccagccuagaccacauagugagacccuuucucuuaaaaaaaaauguuauaugaaggauucuuaaaacauugaauauagaagacucuccuccuuccagauacacucauugucauuacccaccuaucuuaguguuuuuguguuuuuuugaaguugcuuggcuuuaguuuucuuaaauggauaagaucacuauauguucaaaaguuguuucguuaagugugguuuggcaaaaugaauauauucgcuuagauaguuguuuguuuucuucauauacaaaauucuauuguucugauugaugcaucauuuucucaccccaagcaaggcuaauccagguuuuguggccugaagcuuauaauugggagcggcucucauuaagaaaaacaauccaaaauuaagucuaaaagugaauguuuauuuggugugagaaaagaucacaacaaauaaaaaaugccauaaacuucacaaaauuuagacaaguagcuuauugcuauuauaacuugcuguguuuauuauuaauuaacaguccaauauauuauaccuauuugguacuuuuuuucuaccuauuguggccauguauucauucaucacuucuuuacaugacaguuuuauauuuuauauaggaagagucuuuuccucuugcauaagacuugacagaguaccaaccauggaccaaauucagccugcuuguuuuuauaaauaaaguuuuuugcagcgcaggcauauccauauaaucuauggcugcuuuugugugcaacaauggaugaguugaaagagaucaugaguuggaagcguaaaguauuaaauaucuggcuuuuuacagaaaaagacuccuguucuaacauauuugcucaaaauuuauuuacuaucgauagcugugaagcugaaaaaaaaaguuuugaaaccaguuacuaguaauguaauagcacaucuguaauuuccuucacuuugcauaaaacauguuucuugccuggggagaacuuuacaucucauuuguuuggaccacugucccugaccccugaaguguccauguaguuggaucauaguaugucacacccagcaggagcugggcaacacucaugcaaauccuuggguuaaagauugaguccggaugcaucaugugguccaagagggacaggaaauuacugcuaggagcuaggcggauacagagauagugcauucuugauggaaguaccacgaucaucuucagggacagcuaaagaggagccccuaggcaugaggcuacaguugcugcugguccugugucccaaaggagaauaaucaaagccuuguaagggacucuacgaaguaaaagauccugaaacuuaaaccuaauuagcuucaugguaaguucaccucuuuuccccaggacaaacaacuuaaugucuguuuggaguuuuucccuucauaaacauguuuuuuuuucucaugcaccagcaauccuuuacuuucuacaaccacuaccacaaacucucccucccugccauuuucccugccccaaaauuaagguaaaaaacaaaccaaaagggggcguuagagaaauaaaacuauauuaaggauauauccuucuuggaggaucauuuagcuggcauagggcaaaaauaugacaaauuaggauugggaugaaucacugauuauguaguguauguugaguauagaauuagcagcugauugggaaauucauccaaagcuguauaauaugugaccucuggcaaauaaauugagcucaccuauaaaaugaggggauuguauuauaugcuugauaaaauauauggugaagugguauuaagugcuauuuggcucuagcauucaggaauacccacaucccaccagcaacugcaguaacuacuuuucacccucucaucccaaacuguucccacagaagaguaguagcaaaguuaaaaaacaaaaaucucucuuucucucccccuuccuuccugccucccucuuucucucucccucucucuuuaccucucucucccuccauccugcaguugcacucucccucccucucuuuuuuuuccccuuguuaucaggacuuggggcuccacuaguaauguuaaacuuugggccgggcacaguggcucacgccuguaaucccagcacuuugggagggugaggcaagcagaucgccugaguucaagcaaucgucaagcagauucaagcagaucgucaggaguucaagaccagccuggccaacaugcugaaaccccaucucuacaaaaauacaaaaauuagcugggcaugaugguggguuucuguaaucccagcuucuugggaggcugaggugggagaauugcuugaaccugggaggcggagguuacaguuagccaagaucgugccauugcacuccuccacccugggugagagagcgagccuccaucuaaauaaauaaauaaaaauaaaaauaaacugauuggugagcugggacuccuaggguacccccuuuccaacuuuauucccugaaaauccagacccaaauuucagguuuuaccauaauccaacugaauuugcaagaaacagaaggaaaaggagacagaagagagaggaaaaacuccuuuuaaguagauccacuuaaguuacaggguagggcagaagagaaccagccgcaccuaugagcugcccuuuuaacacaguguccucacccauuugcaaauauaacccagucuauaaugagaucaguauuccucucaccuuuaucuguauaugauuauccuucugguaguagaaaguugagaauacaguaagacuugccauuuuuaguuuuaacaucuaauuuugauuguuuacugguaaugcuaaaggucugugccacauaauacuuugcaguuuucuagauguaugaauuuaaaucauaggcaguauauaagauuggugugugguugugaaugaccuaagccugcuguguagcacacaccuuuccauauggcuuuuguauauaauaaagugauuuuuuaaaugguuccaaacaggaaugugcacugauaaugaaggugaggucuaaaacuuuuaugauuuguaaccaaaaauuugucauaacuauacugcuagaaauggaauagaggaagacguggagccauuucuuauagguuaugucuuuuaguauauuaaaacaauccccuacaucuguuaucuguuguugcaaacaaaccaccuaaugacuuugugacuuauagcaguaucaacaaauuucucauucuguagauugagugauuggucugcuggugacuaaucucaccagaauguagggacugggcucagaaaggacaguugaaauggacuagggccuugcucucuauguggucuuugauuccagguuuuagggcagcacuuccaaaagggcaagcuacaaggugcaaguauucccgcuucuccuuccauuuaccagugucuucuucaucaaaacaagucacauagacaaauccagcauaaguggaggaagauaauauauaagaacuugaaucaagggccauuacaggaaugaugugcuacuguaccaaaucuccagucaagguuuccaaacuguauguggcuguuuaucucuuuaaaucacugaauugagcuguguuuuguauuacuuuaacauuaaaucugugucuucaauccaugccacucuucucuuucuuauuuccuacuccacacaguucaccaaacuuuccuaugguagggucuuuuugaugagucuacuuagaaugccauuuccuccauacuuacuccucaccagcgcuuuguucacuugacucacccuuuuucauucuucagguaagaugucaccucagggaagccuuccuacacuaguuagguuuuacauuuuucuugcauacuaauuuuuccuaguagcauuuuaauaguuauuaaugccaaucuccccuuuauuaacuagauguuuuaugaggaccuugucuaauucauuuuuguauuugcccucauuuucauucuuguccucacccccaguuaucccagucccuuguacauaguagguucuucauaaacauuuggugaacaaauaugucuggcagagaaauuuucuuaaaaagcagcuaagaucuaaaagacucucuguguuuggucccuaagauagcagcuguuucuaucuggcuccguuuuucuucacuguugagauucuguuuguuauuuuaugcuuuugugguuuuccuccuucauuccuccagguuugcuuuuuuagaaauuuauuucuuguggagucuuuugucauugccauauucuuuuuaaaacguguacuguuuuuguuuguuuucucuuuucuuuucugguuauuucucauuguagaaauuaccaggugauaagaucccuugucuccaaagugaauuuuuguguuuucuuuuccuggauaguucuuacugauacucaccacucucaggaguuguuguucccugccagauacauuguuuuucuuuuuuaaauuuaugauuucuguauuggguuuugaggugggcagguaacagguguugcuacuuuaauuauuuagaacauuguuucaugagaucacuacauaauaaacuguaggaauucaaccaaauucuuugcauuucuuuacuuuuauacuacuuuuuauaauguauagauuaaaauuuuacagucaucucuuaguauccaugggggauugguucuagggccacccacagauaccaaaguucacacauacugagguccuuuagaacccacccaugugaaaagucugcccuccuguuuuguggguaucucauccugcuaauaacuguauuuuucaauccacguuugguugcggaugcagaacccugcgauauggaguccugacuguauuuagugaagaagaucugcauguaaguggacccacacaguucaaacccauauuguucaagggccaacuguauauucagaguaauaauaggucauuucauguaaauauaucaucagagcaucuaggaauguauuuaaaucuuagcuuuuauauaaugagaacacuuagaauggauuuucucauguuaguuuucagacauuugaggccaaaugcaacauucagauacaugcguacauauaaaaguuggaguauuugacuguuaaucuaggccaacaugaucauagaaaagacuuuauuuuguuaagucauaugauuuccccccacauuuaguguauuuuggauauuuauugaaaauauauauuuggccaggcacaguggcucgcaucuguaaucccuacacuuuaggaggccaagguaggaggaucacuugaggucaggaguuugagaccagccugcguaacauaguuagacugcaucucuacaaaaaauuagaaaauuagcccgucauaguggugugugcugguagucccagcuacucagaaggcugagugagguaggaggaucacuugaaccuaggggcuugaugcuguggugagcgaucucacucaccauugcacuccugccugggugacagagcaagaccuugucucaaaaauaaaaagagaaaauauguuuaaauauuuucuuuaacauuguauauuuguuagauuaaaauaauuuuaguuauuauuaaauauucaguuauucaguauuaaaucauuuuaguauuuguuguaggcaguugauggcuaaaaacaaggaucccugugacuccuaguauuuucuagucuuuuuguggucuagcuguuucuguagucaaagaaauaccuauuuuccugaucuaaaauucuuauucugaccuguuacauaaugugguuguucugaaaaugugaaaggaauuuaaacaguagaagugcugaauguuugugguuuaagucuuaugcaggauagaacuuuuaagaaaguugguacacauauagagggaauaggaggaagugggaguuuucuuaguuuugggccauugcagcaguggcuaacauauauagagguaguaauggcucuggggagaggaccaccuucucaagauugcugugguugugaaagagagcuaagggucauacauuuuaaugaaucauucgugcuuguuaaaguuagaaauaauuucauacuuaaagauacaguacaaagaacuucuauauauccuucauccagauuugccaaauguuuauuacauuuaccauguuuuuuucucuauauauauguauacaugcauguuauuuuuuucugaauaacaugagaauaaguugcagacauaaugccucuuuauaauauuucaggcuauauauccuaaaaucagagucauucuguuauuauuguaguaucauuaucaaaaucagaacauguaguuuuuaacaaauacuuguucacuuggggacaaaguauagguggagugaaaguacaagcuugcagaacuacuuuaagugcuuaugggaauugcagucuuuuuagugguuaggaaaucaauacagaaaauuauucugauuuagaguaagaccaguggaauaacagaguaacacaagguacacaaacaagcacuucagaaaugugaaaaaaaaaccaaacaaaccaaaaaacuccaauaaaagucauuucaaccuaaggaaucagagaaauacuucucaacuggugcagagucaaccucaaagagguggaagucccaggcagaaggacagugggagggaauucacuuccuagaauacaucccccauauucuuccugcccuugaucaucauaguucugagaaugaauaugucauuacaguuacucaguacugaaguaucaggaauacacaagauaugacagguucuguuucuaccaaaguugauacaguacuuuuuuuccuuuuaauuaccagauuuuaaccuuaacauuauuaggguaauaagaaauagauuucccuuccuaagcacuuguucuuagguuguuuuucauuaauaucuucuuaauuacgaaagacaagaaggaauggaauugauuuguuguaauuacuuaaaggaauggaaggaaugucuguaaaaacuuaauuaagucacugucaaucuagaguguggggauuagugacuguuuuuauauugucuagcauuaauauacuguauuaaauguauagcaguuauucucauauucacuguaauuauucugaauuagaaaaggcuuuacaaggugcugugguaugucauuuucagacugccagaugaagguaagaauuaaugaaauagacacuuagacugauaauaagaguguagcaaauuuuuugaaaauccaguuacugaaaauugcuuuugaauaguuguuuuuuuaguuuuaauguuuauaaugcaguauccugucugugaaaaauuauagcauuguuagucuuuauuucuuaagcaaguguuuuaagaauuuaaguuuaucuaaagguuaaaauguuuuuuaguuuggguuuuuuuuuguuuuguuuuguuuuuuaaaguucacauauauagccacaugauguuuuacaacgugaauauuuauaacaucaugaauauuuaguccuuuggcuagcaaggggauuuucauaaugggauuucagacccuauugaauaacuuuuuugugugugugugugagcuguuacuucuugauuucugguaaaaagcgaaguagggagauuuuuagaucuucauuuugguacaucuaguuuccuaauugcuaucuuuuuagaaaugaauguauuuugacagcaccauacuaaaaaagacuuuaugcgaauucuccuuagaacuaacaaauugcuuguuugauuuuugcauucuucagccugguauuugguaccuuuagauaguguaugcaagacgcauuuuucugaaguuuucagugcuggcagcaggaugccuguggcacuaucauccugagauugugcacuugcaaacacaaguguguuuugagcaggccaaaaagugucccacauucuucagucuccucuuugaaacccagugucccaggauacacauuuuuuguuuuuaaguuaucauaauuuuuauugacucuugcagaaauuuuucuguuccuuuguguccuacucaguacuguaugugaaguucaagguugaguuuggucuguaauguuaaaaacauaacauugaacauuguuaucugagcaagucuuuauggacuuuugauccuaacaguauacugaucuuacauuucugaauuuaguaucuaauuauaaaagauuugugcauauaauuguucuuugaaauuccucuuaccaaaaaagggcaccccucaggcauaguucaguaaaccuaaaacagcauaucuucaaaucuuaauguagucuauuuuuuauuacagagcccaaauuccguugaacuaagguaccauaauuacuuaaucagcuccuauuuuagguuauuucaguucuuccucuuuaaaaaaauauauauuuauaugaaauauuuuauuuuuauauuuauauuaaaauaugaaguauuauauucuaaaugauuuucuuaauuucuaguuuagaagugaaauuacuuuaucagaaaacauaauuauggcuuucagaggauuuguaagugcuuuaucaguguaaguguguaucacuuucauagaaacuuaagguugaauaguuacauucuagguuauaaaguaaacuuaauuuagaauaaaauuaguuuacaccuuuucaugauauagucuugaggaagggggcaacaugguguacuggaaaauccuaaugcccugaaguguccauugcauguaacgaguuagcuucccuccuauacaucugaaaggguucuauuuagggacuauccuugguaaaauugagacaauagucacucaaaucuuuuucauauccucaguauagcauuaaaacugcguggccacuugugcaaaucacuuacaaucuuaaacucacuuuagaaaggagauacuauaaucugccuuccagggugguaauacugcuuucaaguuugucucaauccuuaucuagauaagugcuuaacugcuuuauacaagucagccauuacuaaugcuacuacuucauugcuuaaguguucacuuuauugggaaacaguguaauagggggaguaagaaugcuagauuugaagucacaaauugccuggauuuggaauuucagcucugccauuuagcugugugguauugggcaaauuaaccccuuuagugucggguuucucaaguaaaaaaugaaguuaucauaguaauaacaaaugaggcuauauuuaaaagugauuaacacauuuccuaacacauuuuaagcaucaauaaauguuuucaguaauuauuguuaugugauuauuguauuaguuauuuauuacuacauaagaaauuacuucagaaacuaguggcuuaaaauaacaauacauguuuauuauuuccuuguuucugugaaucaggaauuuaggagcagcuuagcugggugguugcggucaagcugucagcaggggcuaugaucaucuacauauuauuuugaaccuaaugguuauaaauuuuauauuuugcagacuaugucuucagcaguggugcaguuauaugcagcagaucggaacuguauguggucaaagaagugcagugguguugcuugucuuguuaaggacaauccacagagaucuuauuuuuuaagaauauuugacauuaaggugaguuuuguuuugcuuucacuuuaaacuaggugauuagguuuucuauaucaauuauaauuuaguuuagauuuguuuauccuauaugugauauuuaaauuuauacauaaacuaauauuagaagagugaagcuugguuuuuagauauugcauacggaaaucaugaccaaaugggaacaugucugaagccagaaugugaauaguuuccuauuuuaucuuucuccugcuaccacgcauuaaggcuuuuuuuuuuuuuaaauuaugccuguugguucuugggcuuucuuuacacucuguauuuuuuuaaugaaacucuuuuauuccaccugguucauuauagaauagcguagauagucuguucagguaacaacaaaauaauauuuuagcucaguauguacuguuauuuagcccagguuuaaaacauuucaauaucuauaaaaaucuguuugcuacucauuuuuccuuauauuguuucucaugauagauauauucagauuuucauagcuuuauaucccucccuuccaaucauaaaucacauuguuauagauugaauaccuuguuagguauucauuucuuacaguugucauaaaaauauuuugcuaagaugaagucuccauuauuuuuuuaaaaaaccuuucuguaaguaagccuccaugauuaauauuuauauguggcaauaagugcaaugagauuuuaauuacaaaaaacuaaaacugccuuuaaacucuugggcgcuaauaugaccugauagauaacagugaagagauuuuuacaccucuggucucagcuuuauuuguaaaaucagauaaccaucuugguuuguuaugagguauuucacugagauuaaaugagaucucaguuaugguauuugguaaauuagugcuucuuuuguuguuguuguuguuguuuugagacagggucuugcucuugcucugucacccagccuggagugcacagcuuacugcaaccuugaucuccuuggcccaagcaaucuucccaccucagccuucugaguagcugugacuacaggugcaugccaccacaccuggcuaauuuuuguauuuucuuauagagauggguucugcuguuuugcccagccuggauucaaacuccuggacucaagugauccuccugccucaggcucccaaagugcugggauuacaggccugagccaccagucccgggcuaaauuagugcaucuuaaugucugcuuccaagacagcugagagauaugacaugcuucugucacuagcaguggcuuacuaguaaucacuagcaguggcuaacuauggcagugauucugggggguggggaacacauacguaguuugaaagaaacccccaagugcuuugacauauuucucauaaccauugagaagcacuauuuagaaauggcauacacuuacuacuccacuaagaagaaagggauuccauugcagugguuauaaugugugaacaguguauuuuacauauuuuuaaauuguggucuagguagaaccuugcauuucugaauagggcaaugacuaucuuucucuaaccacuuauuuccaauugcuggacacucauaauucgucaccuuugguauuaagauuaaacauauuuuuuauacuauggcaauagauauggcagccaucauggcacucuuauccauaguuuaaccuugauacauuuuaauuaucagucucuuucugcaucaugauuaauacuacuuauacuaguauauaauuagaaagguacucugcaaaaguuaagaauuugaagaugguuaauuagcaguacaaggaagguauauuugacccucccacaucuauaaaauugaggaaaagaacauaaaguauuccugcaguguuugauaguacauugucuaaauauugcugguggaacugugcuuugguaaucaguucauguacaaaaguauccuauuccuucuauguaacauugaugaccuaguaauuauucugguuauuauguauuugaccaaguagcugaauuuggaaaugguuggcuagugagauuauaucuuagcugaauuaaacugacuugauauguagguuuuaugaaagauacguuauccaguguuuucaguuuuaagaaauuacugauuagauuaugugacacuauuuauauauuauaaauauguuacaugugugcauuaaaaguuauuuuuaauauaaacaguuuucuuaauaugagucaucuucuuuguuuuauuccuagagauuauguuuugguaguucuuauuuuaauuuuuaacuuuuuucuaggaugggaaacuauugugggaacaagagcuauacaauaacuuuguauauaauaguccuagaggauauuuucauaccuuugcuggagauguaagucauauuuuucuuuauugccaucuuuacuuuuuucauugcuugccuuuucuaauccaaauuauuuauagaaccuuauugaaagaucaaauucaauuugcuauuuuauuuuuuugcugaagaugaaauauucaaauuaguauaugugucugcugugauagguaacuucucuaauaguaaucuuuuacuugaacuucuucaugcuuuuguguuaaguuauucagaucauaaaauaaugucuuaucugcuaguaaaauuaaccuuucguucuuuagaaauauacuucuuuuccucauuguuuuuaugauauaaagcuaaauucauacauucuguuguuuccccuuugugaugaaaauauuucagacuugucaaguugcucuuaauuuugccaaugaagaagaagcaaaaaaauuucgaaaagcaguuacagaccuuuugggccgucgacaaaggaaaucugguaacccuuuuuuaauuacuuaaaucaggccagcaaacuaaugcucauggggcaagugugguccauuuccuguuuuuuguaaauaaaaguuuacugaaacuuaacuguauucauugguuuacauguugucuuuggcuauuuuuugucacaacacaguuaaauagugaugacagugauauaugguccucaaagccaaaauuauuaucugaaauauuuacuauuuacaaaaaaauuuggugguccuuaccuuaaaauaaauaauauuuuuguugagaacuauuuuuuuuagauuuaccgaagggcccaauacaauaaccuuuuuuguugauaaaauuucauauauauugacuuuuaauuuugcauuugugauagcauuuuuuguaaaguuuuaaaaguauuuuauacuuuguaaacaaagacuuuagguaagcuuagaagcaaauaagcagaguugcuaacaagaucuguaaacauugccuugucuuucuauuuuguuccuaaugcuauauacuauaaaacccauaaggaacuuaguuuagugugugaaacaacucuaacacauauaaaacaauuauagaacaaugcaggauaguauaaagcuuuaaguuaauuggaguagaacuauuacuugacaacagugaaccagguguuucucuuguaaaguggagaagggugacuaggaaaggggaaccucuccaaaaucaucuuaagcagaugaguuucagaagaaagaacaugugcuuucauccaguccuauaguuccaaaaacuguaugccaaugacucucaaaguuuuuucuucaguacugacacaucuucccugaccuucagacucugucuacucaaguggcagaauagccuuuagacuuaacacggucugagcagaauauuugauccauguccuguauccugaaccuuagccccacucagaucuguuccuauucuucuacuaaucuuccuuguuucaguaaaaggcauuuguuccaucuuaucccucaggcucaccauggucccucauaaauccuaucagaguccuauugacucugccuucaaaaacauguccugucugacuauuucuuaccauuucugcugcuaccauccuaauccaggccaccaugaucugucagcugggcugccacacuagcucucugacuggucuuccugcugcuacucaauccuuuuuacuaucucuuuucuauacaguagccagaguaaacuuuuagaauuguagauuagguuauaucacuuucucuauuuaaaauucuguaagagcuuccuaucauauacacauaaaaucuauaguccuuaaccauggccuguggaacccuacaugaucuagucccugacuuuccuucuugucuccuuucacugugccauuugcucacuguaguccagucuucaugauguucuuucauguugcacccuccuuggggccuuugaauguauuguucccuuacuuauuuuauuuagaucucuacuuaaaugucgggucuucugaaaaaucuuccuuagucacacguaugucaauuuaggaauaagacaguuuagugaauuaauuuuuuuauguugauguugucuuacauauauuuaauaauauucuucuaauuuauuuucuaacagagaaaagacgagaucccccaaaugguaagcuuuuugacaauuauuaaucuuuuaagauuuuagaugacaguuuaauccuuguggaaacauguaccauacauuaguaauauuuaguaucuuuuacauguuaauccuuguggaaacauguaccauacauuaguaaguaauguuuaguaucuaugaucaaauuauacaguuuauuguguuccuauuuuuaauuaaugauugacagaugagacuuaggaaacaauauucuuugauauuuuucuaacaugaagaaagaauacauagggugaagaucacuaauacuuauuauauuuuaauucuggauucacaguugacuaaguauacaaucggaccuuaacauuuuuccuagaggcaguacauuuugucuagaauauuuguuaauguccuacuuuaagauuuaccuuucauucuuauuucaaaauauuauuucacauugcuuauguguuauaugaagccccuuucaaaaugaacaccuacuguugugguguauuuagaacuaauuuagcucuguauaaugcucuuuaauuugauaaugaccacuugaaguauuaugaauucauuuuuuaaaaaacauugaauaccagagaguaaaagcagaauaccaggauguaaaagauaaggucucagggguagaaauucuuacucuagacuucauaaacucccugaaauugugugcuaaauauguucuuuucucuggagagagaggauccauggcuuucaucguauuuaaaugagguuccugacucuaugaagguaaagaaucauucuccagcacacuuuguuaugauagagaaaauggcugcuuuuuaaaagcauaucucaaauccucuuaucagaaccuagaaugauuauucaaggaaaacuuacauaauacagaguucuuaauauaugacagcuauuggugauuguugggguuucuuuuaaacagauacguugccuuuugauuuuguccuuaaauuucuuuuucugauacagaaacaugaaccaaauguugcuguauuaaauucuggguuguuuaccuuauuauuaauuuuuuaaaugccugacuaccuucaguagugcuuaacagguaccaaauauuguauaguuucacuuuuucuuuugaauagaaauauuaauacuuuuuagggcuguuacggggauugaaguaaucaaagcuuagcauagugcuuaauaaauauuaguuauucugaugaagaugaugacaacaauaauagcaacuacuaguuaaugaucuuuuacuaccugccaggcacuguacagcaaccuucugaaguagcuccuauuaucucuuuuauagauaaggaaaccgaagcacagauagguaacuugcucaaggucucauaacuaguaaguagugaagcaagauucagcaucagaugauuugacccuagagacuggcccuuuaaccacuauguuaugucaagaugauuuugaaggcaaaacugagacacaggguaaauaucaugucucaggauauauaaauuaguacauggcagaggcaaaagaaacagaagcagcugaguuacagguugcucaucugugaacuuuuaauguaguaguagaaauuuuccuugauauaagccuaguauuucaaccuuuuugaauuuguuacauuauuuugaguuuggagaguauauacaguauugaguaccaacagagaagacuuucuaguggugccaucgaaacacuuuggggaaaguaaccccauauuuuaaaguguagaugcuguagaaauaauauaauuaaaauuaagguuguaaauacauguauccauguuggaucaguuccaggauccccccauggauacaaaacuucguugauacucaagucugcgauacaaacaacauaguauuugcauguaacuacagauucuccuauaugcuuuaaauccucuguagaguacucauaauaccuaauacgauguaaaugcuagguacauuuggucuuagccaaaaggcugagaaguaaugcuggguaaauaguuguuauacuguauugucuagggaauaauagcaagaauguucuguacauguucagaacagauggacccauccauuuuuauuuuuaauccacaguuggucgaauccauggauguggaaugcauggauauggaacugugaauauggagggcugaacauuuauaaaaugaauuucugaagaggcaucuaguuuccaugaauagauagaauuugaaaauucuuuauauaacagugguguuucauaauuuuauuaccccuacuaagagacccacuuagaauuaaauguaguuucaggccgggcgcgguggcucucgccuguaaucccagcacuuugggaggcugaggugggcggaucaccugaggucaggaguucaagaccagccuggccaacauaacgaaaccccgucucuauuaaaaguacaaaaauuagcugggcaugguggcgcaugucuguaaucccagcuacucgggaggcugaggcaggagaauugcuugaacccagaaggcggagguugcaagugagccgagaucacaccauugcacuccagccugggcaaaaagagcaagacuccgucucaaaaaaaaaagaauuaaauguaguuucuuucuaugaguuggccauugguuuuaaaucuuuaguuuuaaucauuuggcccagugguuucagacuucuuucauuaaauaaauggaggguuuuuuuuuuaauaguguuguuaaaggacaaaauuauacagcauguauugccaauacuuguauacuuauaaaauauacauauaauauggaauuaauauauuaauacacaaagaaugaaauaaauaauuauuaauacaaguuguaauauuuuaaaacugcuuugcauucaacuaucuugcuuuccccacuaaguggagaccacuguuuaggaggcagcauuauuacuuuacuguauuuggugcaccaccacuagguggcagugggccccuggaccauguccuccaguagcuaugcaggugcuuugucucagauccuuauuuagauuaucaguuuaccacaccuuuucaaauuuuaauuauuaaaaagauacuuuauguagaauuuacauacauuccuaaaaugcaguucaguaacuuccucacuccuaauuucuuuauuggucagucucacauuuuagcauauaugcuuuccaaugauuuguucucagcuucgugacugcuugacaucagaggccucuaggccaccuguuuuucaacuguuuuccuuggugaggcuucuuugcuucuuauguaauuaaugggaaacuugaguucuuuuagauuuaaaauuaacuagacaugucuguucacaagaacauuuaaaaaccuuuucaugcaacaguuauccuuaaucagaaggaguuaauuugucauuuguuuuuuaaaaaagaaggaaaacagcccgccuucauuauauguuuacauaguaguucuuaggaggaguguaauuucauaaauggaauaauuaaacuuuacuagaaaugacuucaguacguacaucuguuacuaaaucuuucauauacuuuauguuguuuaaaaaauggcucuauaccuuaaacagguuaucacuuuuuuuagugugucgcuugaaacagauacuuaauuuggcucuagaauaccauuuuaaacuuauuuccuaacaucuucaaacucuaaaguaaauaaccauugucaacagaaauaaccgaguaccuaaccucuugaauguauagaaauccauuuuuuucuaaauucuguaaguuguuaguaaauauuuguugaauaaugacuuguuggaccacagaccaagaaaacugaaaaauuggcaaacaaagaauguauuaugacauuuguaaaauuagcgguguuauccaccuuguaguuugacuuuuguguaagagguauaagagguagaauaguuggccgggcacgguggcucacgccuguaaucccaacacuuugggaggccgaggcagguggaucacgaggucaggaaaucaagaccauccuggcuaauacgaugaaaccccaucucuacuaaaauaugaaaaauuagccaggcuuaguggcacacaccuguagucccagccaccugggaggcugaggcaggagaaucacuugaacccggaggugaagguugcagugagccgagauggcgccauugcacuccagccugggcgagagagugagacuccaucucaaaaaaaaaaaagagguaaaguaguuaauuggaaggguaguggacuaggaaccaagauaucagaauacacuuuugcuucugucacuaaucauaugacuuuauaaagaucaccugacucuuacuguccuucauuuucauuaauaaaaugaaaggcaauuuugaaaagaaacucuaauuucccaucuaauacuaauuuucuauauaucuccauuauauggauuuuucuuuauagucuuacuuaaauaauguuguuuuuuuuuuuuuuuuuuuuuuuuuuuuuuuugagacggaguuucgcucuguugcccaggcuggagugcaguggcgcuauuucgacucacugcaagcuccuccucccggguucacgccauucuccugccucagccucccguguagcugggacuacaggcgcgcgccaccaugcccggauaauuuuuuguauuguuaguagagacgggguuucaccguguuagccaggauggucucgaccuccugaccucgugauccgcccgucucggccucccaaagugcugggauuacaggcgugagccaccgcgcccggccuuaaauaauguuuuaacuaguacuaaugaaauucaucuauaaugacuuaaagagauaauguugaugcauaauaauauauucaugccugauuuuuggguagagaaagaggggaaacagucugauuacaguaugaguuaaacauuguuacucauuucacauaucacuuacauuuuguuccuauccucauucuugaaucuuccucagagacagcugaauuacuuucucuagugaguuauauaaaucaagguuauaagaagcugauuuuucaaaaauauacuagcuuggauaauuuaaaucauuaaacuuaacuuuauccaacuguguuuccaugcuagucaucuauaguauaauagauggcuuuuauauaagcuaaaguggcagaaaauauuuuuguuguuuucuguuuuuauauuuuacuggugagucugauuguuuauaguugcuauuugaauacuuaguuccggaaaagucauaugaauaaagagagugccuaauucuuuuucuuuuuuuccuuuuuugagacagggucuugcucugucgcccgggcuggagucaguggcgcaaucucagcccacugcaaccucugccucccagguucaagugauucuccugccucagccuccugaguagcagggauuauaggcacacaccaccacgcccggcuaauuuuuguauuagaggcgcgguuucaccauauuggccaggcuggucucgaacuccugaccucaugaucugcccgccuuggccuuccaaagugcugggauuacaggcgugagccacugugccuggccagggaguaccuaauucugauacuccuaauucugucuuaauucuuacauuuuauuaagauauaaagauaagaaacaaaguaauuuguagcauccuuauuguggauaguguugcugauacugacugguaaagauaagaagugagagggcagaaagggaagaaugagaaguaaaaguagaccaccagauaagucugugaaggucugaguguaaccccaauucaacccucuagucccuacauucuggauauucucaguaaguccuuuauuuuguacaacuacauaaaugucgaaaucugauaccugagcaaauuugaaaauucacauccuaaucacccuuucaggucauucgauacugcuuaacucaccuuuacuuacugaucuaguuauuuuucauauuauuccugggcacuaaaaaagcuuuuaaugauuuuauccauauuauucacuagcucucauuuuucccaaaaacuauuucuuauccauaucaacaacuuccuauggaauuuuugaaugaaauuguaacuaaaacuuuaggauuauuaaaauauuauauauaaauaggauuugaauauuaagggaaaagaguugaauuuuggugauauuaaaaauaugccuuuccaaauuauuuacuuuuuugauaaggugacauggcuuucauaaauuuguuuuaguuuuguuuuaucuuuaauaguagaguugggagaaaauaggguauauacaauuuacccauguaaauaaacuuuuuuuuuuuuucagauaauuuuaguaaguaggauacuuuggcaguuuggggcauaauuaaagaauaacagucaaguuggauuuuaaggaucaacuaauauacauuagccuugagauuucuauuugccauuuauugauuauguuggggauccccaagaccauccucagagguggugauucaccaggacuuacaggacuuaauauauagcuguacucauggcaaacauuuauuacagugaaaacacauauaaaacaaaaucagcaaagggaaagacacaugggaugaaguucauaaaaaaaaaaaaccacacacaaguuuccaagaguucucccaguggagaacacagagguugcaccuaauuccuccaauaaugaauugugacaacuugugaaauguugucuaaaggaaaagcuugagacuuggugcccaggguuuucguugagggcuaguuacauaggucuacccugccuugcacuuaccaagauuucagacucccagaaggaaaguagauguucaacauaaacugcauuguuagcacaaacaguuuagacacaauaagcccaccuugucagggaauagugggaacccucuugaaauccaacuucccaaguggucaacugagggccaaccuugcaagugguccuuucuaagaagagcagucuaaagugugcugccuuaaacucuuuucuacacaacgaugauaguauuucauauguuuuggaaguggucguuaauguagucaccucagaggaacuuggucucaaaggaggauuugucagagaaccauauauaaaaauaggaucucugaggaacauguguugcccuuuaguugaauuuuuaagaaauuuuucaguugaaugcuccacauucagacuuucauacuuuuaagaucaagaauuuuauuuugaauuguaagacaaguuuucugcuacauuuaguaccacuucugaagauacuauuaauaauauggaaagaugccuuugacauuuuuacuguugauucuugcacaagaugagugcuuuaagaauuuuuguguuuuaaauuuuuaaauucuauacuucugauagucaagguguaugcguacugguggggaaaauaucauuugacuuaaggaugccaguucuggaaaaaaugguaguaauaauuuuaaguacccuuuuucuucuugacuaauaaaguugaaacaaagaguuaaggcuauauuucuuuguuaaauuuaaaacaaaaauagauacuuuacuuucuuuauccuuguuacaagauauguuucacuuuacuguugagcaauguguuggauaugaggcuauuauaaucaaaauuuaagagauuagacuaauuauauuuaaauucuagcuggaaguucauauucuuuaugaaauuuaauggcauaaaaauguaaguuugcuuugaaauagugcaucuacacucauuucaagaacuuaacagguuuuagaaauuuaggcagcacuuuaugaaaaaaauguagaaguuuaaaauauaaauaauuuauaaugaagugauccuauuucagaaaaaguauuuaaauuguaaauuaugauuguauaucaguuaucuuaaauuauaucccuuuuauauaauuugguuuuauuugcagguccuaaucuacccauggcuacaguugauauaaaaaauccagaaaucacaacaaauagauuuuaugguccacaagucaacaacaucucccauaccaaagaaaagaagaagggaaaagcuaaaaagaagagauuaaccaaggcagauauaggaacaccaagcaauuuccaguaagacaguucuuuuguuguucuuaucuucacuuuugauuuauucauugcuguucuugauuuuuaacuuguuagaaaauuuucuucucuuuucgggaggguguguacauucaucacuuggauaccguuuuaacuauguacuuuauuggaguuuuuuuuuuuuuuuaaggcagcugcucaauagauguucuuggaaucuuaugguuuauuuacuuuuucaacuaugagaaaagaaaaauuagauaaaguuguuucuucaacuaauuauugaacauaaaaaugauuucucacuuugcucuaaaaauagcauuuagaaauuguuuacagauacugccuaggggcaguaaaaaccuuugguauuuaacauauuucaagcauuuucauaugcauuauuuuauuagcucauuaugaaacccuuaucccgucauauauauaaugcuuggacucuuaugcuaauuugacaauuaaggaaauagaugcucagagagauuguacaaaaauuuuaaguuucaguuaguagcagagucagggcuagaauccuguucuucugacuccuuguacauaguuuuuaucacaauaugguuaugucugugagaacuguuaguucagaccaaaaauucaaagccaaauguagauuggguuucauauauauuguguuuauaaugcccuuuaugcauuuuguuuuucuauuuuuuuucuauuuucuacuucaggcacauuggacauguugguugggauccaaauacaggcuuugauguaaguauguuuucaaaucauauacguuauaacuguauguggaaauguguuggccuauuuuagauuuuuuuaaauucauuuuugugguuucuaguaucuguuugaaugugcuuguguuuuauguauguauacaacugagguuuaaaaccauauuauuguucugucauucauggcuaagucucuaaagacuuagacuaagguuuuguguaccuuggcuuuauacacuguauaaauaaaauccuugugcuuugaaagccaagagaagaaaaucauuucugccaagugauaauuucaggggaguguauaccaaauuacuagaaaguaguauaaucaaauucugaauauucaguuguugaauucuccagaucuuuucauucuccuguucuuuuuggcaguuuugccguuguuuuauagcacugugaaacugcuggcaaaaauuaaucagcguuuggaugcauuauuuuaaagagauauuauuugugauuggaguaaaaaauauuuuuaguuauuuuuguuauagcuacaauguuaacucaacaaacauacugagcaccucuugugcugggcauugugcaaggugcuugggauuacaggaagauccuugcucucagauuuucaaauuaauuuacuuuuuuuguguuuauuccugauuuuuacauacuuacuuaggacaagguagaauaaaugagcauuggagaugucugaaucaugaauaggcuaauagaaaucuaaaugagaugcccucuuuuugaaggcagggaacaaaaaagaagaauaaaauagggaauauaucuguucaguuuuuuuuaauaaaauauuuuaguuagcacauaaguaauauaagcauguuaaaaguuuaggcaaaauaauuucagaaggacacagaugagacuuaaaauuauguuuuuuaaauugggauauauuuuuauaguuagcaguuacuuucuuuuguagcugaauaauuuggauccagaauugaagaaucuuuucgauauguguggaaucucagaggcacaacuuaaagacagagaaacaucaaaaguuauauaugacuuuauugaaaaaacaggagguguugaagcuguuaaaaaugaacugcggaggcaagguaacuuuuaucucuauucagcguucuguuuuguuuuaaucuuuugaggucaguuucauggaaaccaguuaacauucauacaugugaacccuuccuugagcagaauguugaagucuauggacaacuaauguggcccaucacacugugucuuaacauuauuucauuauaacuaaaaaaacuuuacaagguuuuguuuauucuuuauucauaaaaauccauacaaaaucuucccagcuauucuauuuuaaaguaaaaacuuauaguugccuaaauguuauacuuaaggaauccuauaaaccaccagauuuuauuguaauucagaaguaauaauuuaaauauaaucacuuucuaauuaguaauauacgcauuuccagaauauaaauaauguaaacuuucuauuuugaaauacaaauccuuuuucuuggauaaaguaugaaauuuucuuuuguaccugagagcacaauuuauaaccuuuuaagauuugauauuuauuuuaaaggaccucguauuucaguuuugucuuaauaauuauugcaguaaaaugcagauaaaauacucuaaauuuuccaauuaacagucaucucuuugcuaccuuauuaggacugcuuucuuuucuucuuccuagcuuuugcauacucauaauaguguaguuaagcaaaagcuccgguuaaaacauucuucugaagaacuuaacugucauuuuaaauuaggcauucaguuuacuuaugucuuuuucauugccaguguucauuuaaacuuugauugauagauugacuuauauaguucauaaacauuauuaugccaguacuagucucaggauauuuagauguaaaggauucucaugccucagccacccaaguagcugagauuacaggcaugcaccacuacacccugcuaauuuuuauauuuuuaauagaaacgggguuuuuccauguuagccagguuggucucaaacucuuggccucaagugauccucccgcuuuggccucccaaagugcugggauuacaggcaugagccaccaugcucagccaaguuuauuuuucuguuauaucuuacauuuucacugauguggaauaagaaugcuaauaucaugacuacuggaauaauaguaauuuuuguuaauaacuuuaauuuugcaguguauggaaauucucaguuaauuuguuaauaaccaguucaugucucuggaauaaguaauugagcauuucaacaaagcaaccagccuccuauaaugccauuacuagaauugcagacaauuuuuagagauacagacauuaugcuauaaaaguacaaauguaaauuaaaugacaaaggcuuacauuuugaaaggaaagcauuauauuugggcuuuagcgcagauuaaugugaaugaauucuauuaagcuaugcuacacuauaauucugaaugugaauugauuuuacuuaaaaaaauaaguguacuugauucuuuuuuaaagagggaagguauuuauuuuuauuaaaauguaaacuaaugcuaauuaacaaaauguuuaauuucauugguauauuuuguuauuauuuuguaaaguagaaaauguuuauuccccuuacuuucagaacugguacuaauuccaaaaaaauaaacuauucuguuuuagcucauauuuuuuuaagaaccaauaagaaagugaucuuuaggcugacaauucucaaaaaaaauugugagauaucaucugugcucagguaucuuuguaaaauaaaaugcaaagaugagacccuuuuuugguauuauucaauuuuuauacauguuaaaaugaauuacuuuucaauaugauguuuaugagaagaaaaaagcaugccuucuuuuuuucuguuugcauuucagcaccaccaccuccaccaccaucaaggggagggccaccuccuccuccucccccuccacacaacucagguccuccuccuccuccugcuaggggaagaggcgcuccucccccaccaccuucaagagcucccacagcugcaccuccaccaccgccuccuuccaggccaaguguagcagucccuccaccaccgccaaauaggauguacccuccuccaccuccagcccuucccuccucagcaccuucagggccuccaccaccaccuccaucuguguuggggguagggccaguggcaccacccccaccgccuccaccuccaccuccuccugggccaccgcccccgccuggccugccuucugauggggaccaucagguuccaacuacugcaggaaacaaagcagcucuuuuagaucaaauuagagagggugcucagcuaaaaaaaguggagcagaacagucggccaguguccugcucuggacgagaugcacuguuagaccagauacgacaggguauccaacuaaaaucuguaaguaagcuuuuuuuuuuuucauuuuagauccuuuaucauaauggaauuuuaaaguaauuuauugaaagauauuuuugaaaaguguauucuuuuuuccucuugcuaauucauucuuaacccuauaaauuuaaaaauacuuuuacaugcagugacaugcacaaauuuuuaauucagcuuugauacaucucuauagccauguaacccauaucucuauauccaaauguaggguauuucugucaccccagaagguuuucucauaccucuucccaguuaauuuuuccauaaacaaucacugaucuaaucaccauagauuaguuuuaccuauucuagaacuucaugugaauggaauuuuacaggauguuugcaauucauuguucuagacuuuacuuucaaauaaaagguacuuuaaagaaaaauccuuauuaagcugugagaauuaaaaauagcccuacuugaaaccaauugugaucaccuuaggaaaucuaaaccaguagcuuuaugaaaauuaaaucauguuccaaaguuuucauguucuaaaauuuagauuaguagagaaucagaccaaaaaaauugaaagaguuguaauagaauuucugacagugauggcaaauaaauuuaggauuaucugauuuggaugagguaaucauuuaaucuuacaggucauuuaaucuucuagaguucagcaaacauuuuccuauaaaggaucagguaguaaaaccuugggcuuauauaggcaguauggccucuugugaccacucagcucugcuguuuuaccgcagaagcaccacagacaauacauaaaugaauggacaugcuuguguucuauaaaacuauauuuggacacugaaauuugaauuuuauauaacuuucacauaucaaaaauacucuuauuuucuuucagccauuuaaaaauguaaaaaucaagcuuaauuuuuagauaguuuuaaaaaaaaauccaagaacaggcuggauuuggcccaugggcucaaguuugcugacuccuauccuagaaccuaaccugucuacauuuacauacuucuuuuggagccuuuuauaacauguucuccaggacuucagggaggucauggaugauagaguuuuucugugaaguaaauggagacgacagaggauguuuuaauugaaaauuauuucccaguauaggaauuaaaguaacuuucuagaucucagaaacuuugucuaaaaggaggguaauagauaggaagcacaacuaauugaaugaaaacauguaaacauuagcauagaucuaagaagacucugaucuuuaaaauauaucuagcucuuuucuuuacauguauucaggaugacacuuaaaccuaugaacagucaucucuguucucuuucccccuuuagaucagacuaaaggccugucaagagcaguugaagaacuuuaaagagugguuaguggggagaauuaaugucaaaaugaccacagcccagcuuuuaccuuggaaucucugcuaguuccugugucauucucauucccguaacucucacuccuaacccaccuuuuuguuuuccuuuucuauuuccuuuucacaaaccaacuuuguuucuuucucucauuuagcuauaauaaggugauuuaaaauuuuuaacgaauaaaguuguauccucauuuauuuuaaaaaguuuaagaguuaaauuucuauuuacuuucuccauaacuuucucccaucccaacucucccuuucuuuccaaaaaaaaaaaaagaagcagcaaaaccuguuaauugauguguaagaaugggggccauuuuuauccuaaauaaucacuuuccuuuugauugcauuuauugcaaucauagggugcauaaucagugaacuauuggcauguuauacauguaauccgaguucguuauuuuuugaaaaagaccauuuugugguugaaauuucuauggcuauguuucuuuaaauuuuuugaguaaaucaucaauuuauucugugaugaauaugauuaacauaaaaccauagacuuacuuuaaagagcuaguaggagguauugaauacucacauauauuuuugaauuccaugguuuuaguaccucaaauaguacuuuguucaaguaagcacuucaaaaaauguguuugaugagaguaugcucacuucugcuuugugcucucugcuuuacauuaucacauugcuuaaagguagucuaaaugucccuaccgcuguuguaccuccuugagagccuugugcagaaauacaaagcucugaaacucucuguuaucuuuuuucauuugugguacuucuauacuggaaauaguuaauacauaauguuuaaagccaaaauacuaaggaaugaaucuauaucuuagggggaaccacuuugaauuuuuuuaaaaaagguguuuacuccagaaagaacaaggaguauuagaggaagaauuguacagaucaaaauggaaaguuugucuaaauaaaauugucuuugggaaaugauuaagaauuucaaaaauauauauuauauauguauguauuaaaacauagguaauuauuuaauacagcuaugcuguuucaucuuuaauuauaauuuuuuuuuucaugaaugcacuuuggcacagcuggaaguacuucaguuagggauuguuacuugccuagugaggcagguacauuuugaaaguugaucaacucaucuccuuaaaaagaaauuauauacuaugagaaaagagguucauuuugaagguauaaauguaacauaaagguguaaagcugaauuuuuguaggcaaauauaaguuucuacaguuguuuuucaauaucuucagugugcgucccacguaacaacucuggagucuaaguauuaaccucuguuuauaacaugaaaucccuugauaaaagcuuuaaaguugaucaucuaagucugugugugcuggaauaaacagaaguaacccagcaaguauuauucaggagaggguuuguuaucugaauguaaacauagauuuggaaauguauuuuuggcuuauacauuaagauggaaaggaaauauuuuugaauaauaucuuuaaggcagcaguuuauuucuuguuaauuugauuaaucuuguccugcgcuugccaguuugauaucuuuuuugucuuuuacaauaagaagugauucuaagaaaguaggacuuucuggagacaaagauucuuggcuaaagauuuauuacugaguuuugcuaacuuucuuuuccaagguggcugauggccaagagucuacaccaccaacaccugcacccacuucaggaauugugggugcauuaauggaagugaugcagaaaaggagcaaagccauucauucuucagguagagagagagagagagagagagagagagagagacagagagagugugcguguguguuuaauaaauuugaauguuugacguucuguuauuuuuaugacugucuuugcuagcuuucucucugcuaauugaguaacuacugaugugggcucuaggauguauuuuaaaaaguuguugccugugugacuagucucucugagacuuaacaaaugcaacaccaccacagccauagccauaaauugaaagaacagcuuugggaauauugacaguuuuguuuccuauaucaggaaaugcuaauagacuuccuagcaaacaaccucuaaacaaagcuugagauuuuuagaucucauuccugugacauuacugugacaugaaaaauucagggcugggugcggugacucacaccuguaaucccagcacuuugggaggccgaggcggguggaucaccugaggucgggaguucgagaccagccuggccuacauggagaaacuccaucucuacuaaaaauacaaaaaaguuagccggcgugguggcgcaugccuguaauuccagcuacucgggaggcugaggcaggagaauugcuugaacccaggaggcagagguuguggugagccaagaucgcaccauugcacuccgacaugggcaacaagagcaaaacuucgucucaaaaauaaaaugaauaaauaauaauaauaauaaaucgggccauuuaccucaucuguaaggauuagggauaagaauuucaguaauuuuuacuguuucuagaguuugcuaaagaauacuaacuuuuuuuaaaccuuucuuuuucauuuucuaaaagguugauuugaagaaaccaguaccuauucugagguuauuauuaaacauauacauaccaccauauaaauauuccuuuaaagaaagaacaagaauaugaguuuugcugauuggaguaguugagguuugcuaaauagcuucuccaacaugaugugcuagaaucagaucuuucuucuuagauuuauuuaaucucugugagccucaguuucuuguuuguuacauucagagaacucacaaaacauauagaugugagaauuaaauaguaugucacuaaccugcagauugccuagcacauaguaggugcuuaauaaauguuaccuuccuuuuguuucucuguaaggauguccaugucuuaagauccuugagcaauguuuguuuuccuuaaauaggcauauuuguaccuacccuccauuacagagauagagauaaauauuuauuguggaauaauaauaaaauuuuaacaaaaaaaaagucccugccuucaucgacaugcauuaggucuaaugagagagagagacaagcaauaaacaaagaaaacuagaaaaacauacaguauguuaaauggugacaugaaguaaggacaaaagucuaacagaaaagggaaauagggggcagacuguugagagagagguucauuuugaaaugauaaaggaugauaagggacaauaaagccuaacugaggugacauuugagaaaagaccagcaguucaggaagugaaccauguagaaaacuagggaaaguguauccgauggaaagaacagaaaauauaaagucugugagguugagaaacaaugaggagaucacggagcuugcaagggagggagggaaagaauaguaaggaaugaaauacaagaaguaguaggaggccagugguaaggcuuuggagaccccugaaagugcacuagcuuuuauucugcauaugaugggaagccauuggaggguuuuuagcagagguguaguaaugauccaagcaagaggugauggaggcuugaaccagguuuauagcaccaaugagaagugguuaaauauuaauuauauuuugaauguggagaucacugguuuugaugaugguuugaaagugaagguugaagaaaaagaagagugcaaaaugacuccaagguuuuugacuugaacaacuggaaaggggaaagacuuacgaagaaaaaguuugagagggaagauuaggaguuugauuuuacauauuaaauuugagauaccuauuaauucaacuauagauguggaguaggcauuucguuaugagucuggaagucacaggagaggucugaauuguuaaauugcaugucaguaggauauacauagacaccugguauuuaaaguuaugguuauguuuaugguauagucuucuuuagcauaaaaacagugaaaauuaccuaaauucuuagcccuaauccucacagaugagguaaacugccugaauuuuuuaugucauaguaaugucauaggaaugagaucuaaaaaucucaagcuuuguuuagagguuguuugcuaggaagagauaaagaaaggucuucauucauucauaaagaaauguaaggcuucugugaacuacaugauucugaaaaagcauuuauucuaugcugguaucugugaguucugcuaaauauuucccuacaauaaguuuuuuuuuaauaguauguaauagucacgcuaauauaaugaaaauauaggaugguuuuuacuuauuuucagacccauuuauuuuaacuguuaguauuucugugguaguaccugaugaugaaauuauuagcuacuucuuccucuucaccauagauacugauaaguuucugucuuuugucagucuguaaugccagcauagucaggugucuuugaugcuuuucauccagguaaauuuugugaagcaugucuagcaaaaucugguagcaaauuauuucccuugcuagaagaguaaacagaaauuaacaugacucaauugaacuccuuuccaaauaaauucuguaacaauuuagagcugaccaugagacuuaaauaaauaaauaaauaaauaauaaauaauuaucguuuuaaaaguaacaacuuaguuuagggcuaagagaagauaauguugcuucucuugggcuucuguuaauuuucaaguucuaauacuagagcuccaguacuucuucaaauacuaccuucacacaaucaauuuuacaugagaaaaauagaagaaaaagauuguucuguguucuguacauguaacccacacguaugucaccuagucuuacuggcuuuuuaucauuaucaaguacaauuacucagccacugucccacuuuauauacuuggccuucauggguccuauauauauauuuauauacauauuuauauauauuuauauauuuauauauagguauauguauuuauauauuuauagguguauauauuuauacauauuuuauauauagauauaugaagagguuaaauauggaaagucaguauaauauagaaguaugcuuauaaaaucugauaacuaaauauuccuucaacaaauauuuauugaauggcugguguguagugcuguuuugguguugaggauacagugagaaauaagauaggcaagguccgugcugucauggagcuuaauagauaaaguacaauaauuuuagauauuagcaagugauaugaggaaaguaaaaugggauaggccguuacugauuauggggaagagcuauacuuuacauaugauggucaggaaaggccucucugaggaaguaguuuaugaaugguuucuaaaugaugaaaagauucaguuuaacgaagaaauagcuacugcagaaguucuaaagccagaauaagauuggugaguuuaagggacagaaaggagaccaucuuacuagagagagugacuugaagggagaguacauaugagagaaguuuggggagagagagagacaauaacuggacaaaucauguagggucuuauggagggagguagcaucagauuucauucaaauagcagugguagccacaggaggacuuuaagaaggguagcaacauauuuuuuaaacuugaaauuuaaauaauaucacuccauuugcucugagucaaauagacucuagaguugcaauaauccaagcaggaugugauggugguguggagaguagcagugaaagaggugaaaaagagcaggcuugauaauuggaucgugaaaaaggaggaaguaauaauaauuucuagguuuuuggccugauuaugugacaggauggugaugccauuuauugagauggagcagcagaccaggauggagcaggaaaagaagauuggggaaggaaauaaaaguuagaaguuuugaguuugagaauccauaugaagaguacaagaagguaguuggauuugugacagaaaggucaacccagaugauuuuauacauuaacagguugaaauuugucacauagauauuaaggaacuagaaccauugucuucuaagcccuguuuuaaucuuuaguuuacuaucauacucuauagauauauuucuuuagauucacuuuaaacuguuuuaguaacuagauucuucugggagucacauuaucuguguuucaggaguuaaauaauuggagaaaccacccaagaauuauguaaugucauuuuauuuaugcauauguuuuaauugucuugauuuucuuguagaugaagaugaagaugaagaugaugaagaagauuuugaggaugaugaugagugggaagacugaucuauauauuauauauauauauauauuuuuaaggugaaauacuaaacacuacuuucugucuguggauucuguaaaauuaucauguaaauguucuaccaauuugcuguauauuuuuguugccuuuuuugcuuuuuuuuaaucugugcaauaccucauuuaaucuguaaagguuugucguaauccucuacaaagcuacucccuguuauugugugcaaguuuacaccaggaugcucacuugauuugugaauauuuuucauuccaucaacaagggaguuuaaauacuauaugugagacugacaaaaaccuuaauguaauuuacuuauaaugccagaaggaaaacacuauuuucauacccuacuuuuucuguaccuaaauuuucuuaaaaaaaaaucuaguauagcacuacauucuuuuuuaagugaugcagaccuuaguuucuuuagccccuuuauuuugaauacaaugcuacauaugaauguugaagcugauacauugcacaguucuguagacaucacuacaccgauguaguuucucaaauuuuagcaauaugcucuacauaaaaucacuacagagauacuaguggggaagacgauuaacacaccucuuacaguaauacugccuguuauugguauagcagugguauuugcagacugggaucauaaggagcccuuaaauacuuguuauugacugggguuauuuuuaugcuguagcaaaugugacaggcucuuuuuagcaaaauuuuugaaaauuuuuuugguauuacucugaaacaaaauuuaaguuggaguuucagggauuuagggaguaguuuucauucuacaugaacugagguaauauuaugguaacuccaauauuugguuaaaaaaacuauacaaaucagaauaguacuaaaauacuguagaauuuuagcauuuuuauuuugcacuuuguguggauugagguguucagaaauaccaaccauaaaaauguaaucuaguuggcaaaggugugcgcuaaaacacggaaccgaacaugcauugauuuggauaacuuuugaggguuuuugucaaauagcaugugaagaguuacauuuuucuuaaaagauugguggucccaaugucagaguucuuggaacagauaacugaaugauagauuuuuuuuuuuuaaagauaaaacuuuacaaccugcacauuuguuaugcauacuaaaugguguguuaaaauuaggguuucuuugccucucuacacuacacuaaucugccuaaaggugguuguuucauauuuauaaugcuaauuaucauaccuaccuacuuuaaauuuuagguagaaaauuaucugauuuaaauacaaacauauuuuucucacauugaguaauaugcauaauguaguuccaaauguauuucauuacuauagucacaauauccaacuaaaaauuacgcuaucuagaauuguaccaaccaaaaucucguauuggcagaucuugacaggcuggaccugcaagauguggcuugaauuuuaaccauuuauuacauaaucucuagugaucaugcaucuaguuaucauaagaaauaauuuaaaagguuuuguugcugaaagcaguaaguggugcaguaaaauacuuaaguuauucaaagaauguuaucuuucuugcaagaguaauuuaagcacaugggaaagauucuagacuuuuuguuucuugcaacaacagugcccucugcugcuagaaaccuuuuucuacuuacuaucauuuuuauuguggcuugagcucagucaaucuggugcagaugaggcuggacaacuacuaaccaauaaaaucaggaguuuguacaaaaguuaaauggaacauuauaauuauuuuaaguaauguuaauugaaaaaauuuuuucuuuuugacaauauaaaaaacauuuuaaauuuccuagaaaugucuucaggguaaugccaauuuaagaucucucuuaacuuguggccaagaaauucuagauuuuccagcugacuuugguauaauauauauuuaucaggaacuucucucagcagagaguacccauucuucgaguucaaagcacaauuuuaaacauguaaaauggauauauaauuugccaaagguaauuaauuuauucuuuuuuucuuaaagaagaaaaagacauugguuguuguuacaaaaagucuaaauuacuguugguugaaacacagcagcuguggaguucaguccaggcaugaagacuaaaucugcuuuaccaaguaagguguaagguugcauguuucaguccucuaccauccugcacugugagcagcacuauaccugugcguugucugaaagccuuccguauauucuccagcuaaauggucgucugguagccuuugcauuuaacaaacuagcaugaggcuuuuuauaucuaaaugcuacgugauagacaauuucagcuagccacauauuguauguaugagauucauaaagacuuucaaucauuucauuuucagacaacugaaauuuuguuuaguaugugaauucuuuuuuugaaauguauagugaauaggauguugcacugguggcaauucaucauggagcauaauaaaauuaauuugacccaaauagaa

SEQ ID NO: 191587 - RNA, 107598 nt, Homo sapiens
gucaguauuucgccaaaccuccaggcgccaucagugugugaaccguuacgcagcugguccaccgcgggcggagaacaagcgacuaugcccagggauccugcacgcaugcguggagcugaaccgucagcgugcgugugacgucaccugcgcgcccgccuaaacucuuccuaggguucuuucuagaguacgggugagugaaauuuguaagguuugguguguucauuugagugggugccagacguaacgggcccgggauugaauuaguuuagaucaaaauuugauguaauuaucgcagagaaacgcuuucuuacgaguguuuaucucgagccugcuguguucagcaucuuucuugguguuuugggagaagcagacaggaguuaaguccaaguccccgcccucacagagcucagguggcuugggggaagguuggugcgcaaacauuaaaauuagauaucgacacuagugaguguccccgucaagaggucugugaaauaagguugagccuacgaugcagaaguuaaucucaguucaguaauuuuuguuucuucauuuauuuagcgggugaagggagggggccacagaaacauguuggaguacgaugcuuuuggugcacaguuugucuauacaauauuacagcucccguggggguuaaaaaaaaacacgauuuuucagccucccucuuccccaauaaauuuuacauuuuaaagcacaauguuaaaagcguuuguuagugacguuacagaucuuaaaacuggcuuuuuggagguacuuuacgcagcuaaguagaaaaugguuaaguuucaguuccuuggaagaauguuuuguauugaucuuugcaauaaaauuguaaaauaauccauccuccugucaccccccaaccccgaaccguguuaacuauaauaaggaaaagcauaacuaagucaaagagacuuaaagcaaauuauugacuucauuuuggguaaaacacugguuuuguauuuucagcagcaaguugucagauucccuaguugaauuugcuuuggacaucagugugaagcagaacugauaugccacuugaauuaauaaaggaagucaauggggugccugaaguucagccgcugaguaaauuacauaaaguagauuucggaucccuacagccagguuacaauuauagcaagaaauauauucagguaagaauuucuauaacucagaaugcuuuuuccuacuaaaaggaaugcaguuuuuaaguguugaguuuauuuaugagaacugguuuagguaugguuuuuaucuuugucauaacauuugagauugaauauuucaauaaguuauucuuauucaguacuuauuuagcgaacaauuaucaaauucgugugugaaacauuggaguaaguuucugagguacaaagaugaauaaauauagucccggaacuaaagauaaucacauuucuguggggucugacagaucaaucaccugaucuccaauuaaaauuaauaggugugauauuagcauugugaugugugaacaugagagagcuuuugguucugacagaucacgaaaguugagcuggaacuuacgggauaacagacugugcuguaccuuccuuugagguaaaaagcaguccuuaugugcauguugaggaauuuggauauuacucuaaaagcuaugggaagucuuuaguagguuuuagcaggagaaagacaugauuuacuuugaguucaaaaaacuuugcuccuagguagagaauauauuggcgaaugcaagauuagaggaaagauguuuaguuaagaggcaauuacaguaauuuaggugagaguugaugaugaucugggccaguggcagaggggaugaugggaaggauauugaaaaaagauaguaauaauaauaacuaaaguuaacauucauugcauuuuuuuccaugcguuagguaguuuuuacguauauuauuuaaucaucacaaagaccuaugacauagguacuguuauuaaagacacuguguuucagaaagguuaagcaauuugccugagaucauauugaugauaugaaguagagcaggaauuugaauauagaugauuuccuuuagaccugacaggauaaagaagcagaaucaguaggucuuagagaacaauuagacuagaguggcaaagagaaauucaggaaacuucuguuucuaauuccuagccaacaaggagaagaaaauaggggguacauacuuagggagaaacaugauaaguucaauuuuggucauauuugaaaggucuuuagagguauauaaauaguagugugcaguaggcaaguggauuggggaguuugaagcccaaagggacucucauuuagauggguuugagccaaagcauagaagagaagagaaccauguugaaggagucagugaaagaaaguaguaugaauaaguagcagagauggucuagagaaggaggaagaaacucaggagucuuugauacguaagaaugcaaguuucaauaacacuuguauagauuguugucuaguaggcacucuccuaaaugcuuuguauauguaaucucuuuguauauguucucuccuaagaacucuaaguauuauucucauuuuauagcuggaaaacaaacacagguuaagugauuuauucaaggucuaauagccaguaaguggcugagcagugauuugcauucccauugucuuugcuacuaaacagagcauuauguugcuauuagaugcucaaaggucugaaaaguaucuguucauucuaauaaccaagaaauuauugaucacuuggaaagauuaguuuugcuuaaacacuaagagcaaauucauuuuucaguaguuugaggauugaaugucaggugaaaaaaugaaagcagaaaaugucuuucaagaaaugaguugugauacuuuugauaauuuaaacaaaauuuuuaaaauuuauuuuguaaauaggugugggaaacaagugcaguuuugcuauguugauauauagcacugugguaaaguaagggccuucagugcaucugucacuggagcaaugcagcuuguacccaccaagcaaccucccaucauccacuccacuccuaauccccuaccccuccaaguuuccauuguccaucucuguacacucugcuucuguguguacacauuauuuaguucacauuuuugagugagaacaugcaguauuucucuuucugugucucaguuguuucauuuaagauaauggucuccauuucuauccauguugcugcaaaagacauaauuucauucuuuuuaaugucuaaauaguauuguguacauaugugacuuuuuaaauccaguccuccaucgauguacacuuugguugauugcauaucuuugugauuuugaauacugcugugguauacauaugagugcaggucucuuuuuuauuuaaugauuucuuuuccuuuggguacauacccaguagugggauugcugggucaaaugguaguucuauuuuuaguuauucgaaaacucauuauacuguuuuccauagagguuguacuaauguacauucucaccgacaguguauaacaauuccuuuuucuuugcaccccaaugucuguuuuuucuuugucuuuuuaauacccauucugauugguguaaggugauauuucauugugguuuuaaucugcauuuuacugaugauuaguuauauugaacauuuuaucaugugcuuguuggcuauuuguuuaucuucuucugaaaaauguucauguccuuagcccacuuuuuaaugggcuuauuuggggguuuuuugguugagucccuuguaaauucuggauauuaguccucuguugaauguauaguuugcaaauauuuucucucauuccugagauuguucauucuguuauuucuuuuguagcacagaagcuuuuuagcuuaauuaaguuucauuugucuauuuguguuuuuauugccugugcuuuugaggucuuagucaugaauuguuugccuaaaccaauaucuagaagaguuuuuccuagguuuucuucuauauuuuuauaguuuugggucuuacauucaaaucuuuaauccgucuuaaguuuauuuucguguauggugacauauacguuccaguuucacucuucugcauguggcaaucccguuuucccagcaccauuaauugaaaagugugucuucuccccaguguaguguucuugccaucuuugucauagaucaguuggcuguaaguauuugacuuuauuucugguuucucuauuuuguuccauuuaucugugugucuauuuuuauacuaguaccaugcuauuuugguugcuguagccuuguaauacauuuugaagugaggcaacguguaccuccagcauuguucuuuuugauuaggauugcuuuggcaauuuggguucuuuuuugguuccauaugaacuuuagaauuguuuuuuucuaauucugugaagaaugacaucaguaauuugauaaggauugcauugaaucuguagcuuugggaaguauguucauuuuaauaauauuaauucuucugauccacgagcaugggauguuuuuccauuuuuuuauguuguuuacaauuuauuucauccguccuuuguaguuuuccuugcagagaucuuucaccuuguuaguuaaauauauuccuaggcauuuuauuuuauuuuuguagcuguuguaaaugggauugcauucuugauuugguacucagcuagauuuuuauugauguauagaaacauuacugauuuuuguacauugauuuuguauccugaagcuuuacuuaauuuaccaaccuaagagauuuuugguggagucuugagggcuuucuguauacaagaucauaucauuagccaacuaugauaauuugcuacuucuuucccaauuuggaugccuuuuguuuuuuucccuugccucauuguucuggcuaggacuugcaguacuauauugaguaagaguggugaaaguggguauccuuaucuuguuccaauucuuagagggaaucuuuucaacuuuuccccaauucaguauuauguuggcuguggauuugucauacaugaccuuuauuauguugagggauguuccuucucuaucuaguuuguugaggauuuuugucaugaauggaagaugaauuuuaucaaaugcuuuuucuucaucuguugggaugaucaucugguuuuuguccuuaauucuguuuaugugauguauaacacuuacugauuugcguauguugaacuauucuugcgucccugagauaaaucucacuugaucaugguguaugaucuuuuugacaugcuguuggauucaauuugcuaguauuuuguuaauaauuuugcaucgaugucaucagagauacuagucuguaguuuuuguuuuuguguucuuugucugguuuugauaucagggugauaccuuguagaaugaguuagggagaauucccuccucaguaguuuuggaauaguuucagguggauugguguuaguucuuuuuguguuuuguacaucuaggcugugaauccaucugguccuggacuuucuuuuauugggauuuuuuuauuacugauacagucuugcugucaucauugaucuguucaggaauucucuuucuuccugggucagucuugggaggcuguauguuuccagcaauuuauccauuuucucuugguuuucuaguuuaugggcauauaguuauacauaguagucucuaauuaccuuuagaauuucugugguaucaguuguaaugucucuuuuuuccucucugauuuuauuuggaucuuuucucuccuuuucuugguuagucuagcugguaguucaucaauuuuguuucucucuuuaaauaaccaacuuuuuuuucauugauccuuuggguuuuuuuuuuuuuggauuuuuguucauuuaguucugcucugaucuuuguuauuucuuugcuucugcuaacucugacuuucguuuguucuuguuuuucugguuucauugaggugugaugcuaguguguuaauuugugaucuuucuacuuuuuuucacuacugagucccgcguuguuugcuuaucugggaaauuuuuuauaucucuuuuauuuauuaagcuuauucuggcaggauauaaaauuuuggcuuacaguuuuuuuguuuguuuguuuguuuguuugagcacuuggaaaauguuauucuuucucuucuggccuguaagauuucugcugaaaaguccaguuaguuuuauaauguuuucuuuauaggugacuagauagaugcuuuucucuugguaauuuuaagauuuuuuuuuuuuuaacuuugacuuuacacauucugaauauaauguguaugaugaaguccuuuuugcaguguauuuuccuggggauagcugggccuccuguaucuggaugucugaugcucuugcuagacuuaggaaguuuucauugauuauuuccuuaaauagguuuuuuuaacuuucuaaucucucuucccccuuaggaauacugauaauucauauguuuguuugcuuuauguaguccuggacaucucaaauggcuuugcucauuccuuuuuaugcuuuuuccuauuuuugccugaccgcauuauuucaaaauuucguucugucuucagguucugagauucuuucuuuugcuugaucuaaucuguuauugaaucuuuugaauauauuuuguauuuucuucaauuuuuuaauucaugguuuccguuuucuuuucuuuuuuuaaagaugucugucucauugguaaaucucucauucauaaacagaauucauuuucugauuucuuuguauugguuuucagauuucucuugaaucucauuaaacuucuuuaaaaucacuauuuugaauucuuuaucuggcauuucgaggaauuuuuuuuaauugauauauauugcuagauaauuguuguggucuuuuggugauaucauauuucccugcuuuuucauguuuccugugcccuuccuuugauaucugugcaucuaguguagcaauugcuuguucuauuuuuuuugaaauugcauuuguagcaaagaaauguuuucugaagauguauguauguuguugguuaagauacuuuggcuuugauuuugggugccugugguaguguggcccuuauauugaguguaugaacauuuccuuucuuuuucaacuuacuuaugguuugguauuuuaaguaucuguuagcauauaacgggaucaugcuuuuuugauccagucugacagucucacuauuuaaucagcauagucaauuuauguaaaauaauuauugauaugguuuuguuugucugucaaacaauuugaguucccuuuguuuugccuguuuuuuguucuccuuccugaguucuuuuggguuaaauauuuuuuauucuauuuuauuuucaccauuggcuuugagcaacacccguuuuguuccuuuagugguuaugcuaguacuaacaauauacauccuuacuaagguauacuuacagcuacuauuguaccacuccccauguuacaguuguuauuucucauguccugcuuuuucuucccccuugacaaauauaagaaucuuauaauagugaaauuccauuuacucacuccccuguucauugaacuguuaugaucuuuuacauguacauguauuauaaacucuauguuauauuacugcuuuuguuuaaacaaugagucaucuuuuaaggaaauuaaaagaaggaaaaaguauagucuuuauauuuacugacauauuuaccauuucugguguucuucauuuuuaccuguagauccauuuuuaucugggcauuauuucccuucauugugaaaaauaucuaccauuucauauauuucagcuggggauaacuucucuuagcuuucauucauuugaaaaugccuuuauuucauguuuguuuucaaggauauauuuauuggauauagaauucuguguugacuuuuuuuuucuuuuaggacuauagagaugccgguccacugcuuucuggauucuguuguuucguaugugauuugcauuuuuuuuccugccaccuuucuguuuuaucuuuuaguuucagcaguuggacuggcaugugcuuaaguaagcuuuuucuuugaauuucuccucuguggguaacugagcuucuuggauucauucaguauuuuucaucaaauuugggaaauuauuguauaauauuucuugaaauauuuuuuuuuccugccacauuauuacccuuuucucuuuuuugggaugccaauuacguguguauguucauguauuaggcuauuugauacuguaacacggaucucugagauucuguuccuuucuccuuuauuuuauuguguuuuauuuguguggcagagaggauuuucaguugaguaauuucuguugcucucucuuugaguucacugaaccuuuugucugccauauccaauauucuggaugcauuuuuagugaguuuuuaaauuuuaguugagggggugagggacaaaaugcaucugauaauagagagaaaucuacauuucaguuuugcuugucuauauucuucguauagacguuuguuacacauuuuacucaccuauuuauuucuuuuuaaguuuuauuucuauuuauuuuccuggaauuuucuuucuuauuaaauaagguuuuaugaauuacagcuggucuuuucuacuuaauugcauuuaaaugauuaucagaugcuuguuagcauucucaacuuauuuuacauuuggucaguuagugugauauuucuuguauacuuguauuuauuaauaaagugcuaugauuugauuucuuuuugacauaucauuaauacugauuauuuccaagcugcaucuaguuuugacauacuuuuauuguuuugugugcuugauauagaaauguuaaauacuaugacaguuugcuaaguucuuauuuuauuuuuguucuuacuuauauuagugaaauauuuuuuuaaguuucaacauuuucuuauuuguuugcuuaagagauggaucuugcucugucacccaggcuagagugcugggguaugauuguagcucauuguaaccucaaacuccugggcucaaggaauccuucugccucagccucccaaguagcugggauuauaggcacaugccaccacgcccagcuaauuaaaaaaauuuuuuuuuuauaguggcaggaucuuucuguguugcccaggcuggucucaaacucccagccucaagcaauccucccaccuugaccucucaaagugcugggauuacaggcaugagcauugccccuguccaauuuuaacauuuuuauuaaugaauucuuuuagcuauaagugaacacauuaguaucuacuaggguuaaaacuaggaaauagcuuuuauguauuuuucaugguuaacagauuguuauguagaaugcucacuuuuuuaaaaaaaaagauugaaguauuuguguucuuuuacauaucugaauaauuuuucagcucucuauuguguacuuacccuuuucuaaccugcagauaucuauguuuuuugaauuuuauuaaauggauuuuagugcuacauucuguuuuuugcauacacuucugugaguuuugacgaauacgugcaaauguguauguaaccacaaucacaaucaauucguucaucaccuuccaaaauuuuauaguuagcuguuuugccaacucuaaccacucaugacugcuuaccaauuuccugacacuguuuuuuuguuuuucaagaaugucauauaaauggcauuauacagcauguagccuuuugcaucuggcuucuuucacuuacuaugauacguauaacauucuuucagguuguuuuuuucauuaguauuucuuucuuuuggugauuagaauuuuguugcagccuauuuauccauugcccaguguaggaauauuuggauucuuuccaguuuuugugauggugaauaaugcaacuguaaauauauauguacagauuuuuaucugaacauagguuuuuauuucauuugaguaaaggucaaauguucaaauaguuccuaagcaacaguaugugauauagcucauagguuggcaugcuacacuucucuagauucagcuguuaaggaggcaaggcacccaaauagauuuagguaguauauuacuuauuggcacagcagggaacaugaacuuuauguuugcacugguucuucuuuccuccccaagucccaugggggcagggacagguacauaacgugcacacggaguuuguagcacaucugaggggcacugagcuuagaaaauccccaguuuuuaaagaggguauauuaguuugucaggucagccauaacaaaguaccacagauuggguggcuuaaacauuuauuuucucauaguucugaaggcuagaagaucaguaucaaaguggcugcaggguugguuucuucugaggucucucuccuuggcuugcagaugcucaccuucucgcugugucuucaccuggcauuuucucuguacgugccugagacucuguuguguuucugugugucccauuuucuuuuggggauaccagucagacugguggcacaaaagaggcacauucuaauggccucuuuuuaaccaaacuaccuauuuaauggcccugucuccaaauacagucaaauucagaguuguugaggguuagagcuucaaccuguaauuugggagaacacaauuaaguccauaacaggauguguuacauuuuuuauaucuauacuaauucauuuuuguccuaaaagcaaacaggauuucuagaauacaggcagacucuuauuacaguuaugcaccauauacaacaucucagucaacacugcacugcauauauaugauggugguccaucccauaacaucauaguauuguguuuuuacucuaccuuuucuagguuuuuauauguuuagauacauacauacuuaccauugucuuauaauugccuacaguauucaauaccguauauguuguacagguuuauagcuuaaaagcaauaagcuauauuguauagccucgguguauaguaggcuguacaaucuaaguugguuuaggcauacucugauguucacacaaagacgaaauugccugacaacacauuuuucagaauguaucccuguuguuaagcaccacauaauuauauuauucucagcaauaacucccugcccauccuccccauucagagugaugcagugagggccagaugucuuccugcugugugaaggggauuucuuguacucucagagaggaaggcugaaaugaugcaucuaggaguuuauauagggcagcuauucagcuuuaccccucccgagagagggagagaaaccucauuuccuuaauguaaauacgucauuuggaauuuaagggaauagcuauagauuucaucuguugaauuguaaacauguaauucugggacaucagucucucuggaagucucucaguguccuuuaauuuucaaagcuugucuuuuaacucagguuccaguuuucuuugcucacuucaacaagggcagggacaaauuuccuaccaccuuucuaauggaauaacuuccauuguagguaaaacuguugacauaauguauagcaugaucacccaaaaaggucguuuacugaagacuugaauguuucuuauguuucuuauuacuacuccuaggugcaagucacacuguuuauuugguuaguuucugccuuucacacaagaaacgcagucccaguggcacacaugcuaccccugaaaacaaacaguuuauaauuguugguccccccucuaggaaguguguauuaauagauaggcaggcagcauggguugacagugccucuuguguuauuaguuagcuaguagucuccuaaggccccuaguuuagucccgguaauuuaguuuggucugguuuucagagagacugccucagggcaguuuguuaaauuugucuuaauuuacuaauccauuuguccuaguuauggauggcauuuggaaguaaucagcauccaagcugcaggagcugggccaugcccugcuggcucaugguuagagcaguugggugagacaugguaggcaggcuuagcaguugauuuacuuucaaauuucccaguaguuucugagaguagcaccagaauauuuuuccuugggaaaggagguuccuggaguucugaaagacaaagaugauuaaugccuccccuccccuacaccuccugggaccuaagggauucccuuuccaaguucuagaguuuucuucuccaggugcuagggcccuuucgcaggugcuaggagugucuuccuacaugcuuaggugcuuuuugcucucuuuucauuguucuaaaaccaguguggcccauuccaauaacuauaacuuuauauuuuuucugauuauccccucuacucugagacuuuucuucuaguuggaucacauacaagugaagcaaaagcaccugcuuugaguuuaauuugauuaaugucuuuuaaucuaauugauugugguucucuugauugcuuugcguuuuuucuugccucuuuuguaugccucauauguuguuauuguucaaagcuguacgucuuguggaggacaguggagacugggguaguuuuuauuucugggcauguguaggucuuucuuugugcuaggccuuuaguuuggugcauugaauuaaucuagucggguuuagaguuagguuugggauuuguuguuguuuuuggugcuucaaugcacuagaggcuucauauuccucagaguuacuuuguauguaggaucggagaugguugacgagaggauuuuucucuugucuuccccauccuuaguuuuaggucuuuccuuugugcuuugccucaaauaagaucuccucccugcucaagagcuucucuuccaguaguagaccauguuacuuuuuacuagguacugguuagccuuuaauagguagauguucucuguucugaugaagccugucuugguagcaguagguccugggucuugugaguggggccuucucaaugauccugcuuugccucuagcuguauaggucugggccuuacaccuauguacccguuccugcccaucccuaacagggauagaagguguuuuuuucuguucuugccuuccagcugcaguggguuuucaccaauggucuuggauugacauguuuuuuuuugcccuucucccagcauuuuaaguccuuuguucugaaagaaagauagaggagaaagagccaagcagaguuuccagccuuucgugcaguaacugcugcugccauugcccuacuucuguccugaaccuugucaggucuguagagaagcgcauguaaaugaaugaauuccccuguguuugcagcuugggggcuccauguguuuucauugcaccauacuuggccucuagcaauucauuaaaguguuagaugaauuuuucuuacagaugucugggaacauuugucauuuaccuuagguaagcaaguugcuauaaaaauuuuauuuguaucuuggugugauuauaaacuuuggcucuucuuuguaacuauuuuuuucucauuucagggaaaucuuucacuuuucuuuaacuuaucauagaaauaaaacaauuguuuuauucucauuagaaguaaugagaauuacuugcuuuccucagauuucugcuuaguugguugcccugugaccucaacucucugaugggucaagaaagguucugagauuuacagauuaacuuuuuauuguugacacuuuuuucagcuuucuaucuuuuaaguguaacuacuuuuacuuuugacuaugaaucaugcuuuguugauaaccauauuuuuauuuauguuccuauaaguaaaauugauguauaaguaaaauugaguccuauuuuauaaguaaaauugaucuauuuuuuauuagcuauaucaaagucuggaauauuagccugggaggcuaauaggaucuauuuuuaaauuuuauuuacaaaaaccauccagauuaaaaacuuuauuuuaucugauaaucuaaguaacuuuuuuuaaacugacagagcugguuaguuacagaaacugaacaaagacuaaacuguacuugugucuuaaucuguugauuuguccacacuauaugagauuuccauuuugcauuucuaaaucuuuauuaaguuuucauuucuuucuaggagcaaacaucauuuuauuguuuuguagagaacaauauuacagauuaaaacaaagcuagggaaaguugaucuaguuaucugcaaaauaaggaacugauaguacuuaacuaauaggauuacuuaggaaauuauauuauaaaccuugaaguauuuguagaucugauuuuucucuagaaaaacaaauucaacaguuucuugucuuaaaauaguuacuugaacacaguacucugacuucuugaaagaaaacuguugcuauagaaaauucuaauuuuuauuucuaucuugguuuuauuauaaacuccuuugacuccucuuuguaacuauuuuuuuuucucauuucagggaaaacuuucacuuaucucuucuuuaacuuaucguggaaauaaaacagcuguuuugcagauuggacuacaagguauauaguauaagcaaacuauuucuacuuaucuuuuucccuguaauauauaaauaugugacuucauauauauauguguguguauucuacuucauagcccuuuacucucauaucuagaccauugcaguagcuaacugcuucuaguuucacuuaugugacuuaaacaucuuagcagcuuaacugucuuaaaacuuggcuuuuaacauguuacauagauguacuuguuacauagcuguauuuguuaccuagguguuguucuuacacagggagaauucuuucuccauauagcccucaaguaaucaugguaagcuaggaagggcuacuuuguaacacuuagggacaaaaguagaucucaucugaagccugugguugguuagaacagucuggagcagcaaaugggaaacaaacuacaaaauucuacaacuacugacuacuaaguauauaucagacacuguucuagguacugggguuauaagcugugaacaaaacuuaguucuugucuuauugaauuuacauuuuaggggaaugaggaaaugcagugaauaauuacauaaaguaauaugagguagaaauguggucugaagaaaaagcaaguuaaggugguagagcauaggggaguuaugagaaauaaauuaauuuucugaauaaauuaaauauaaauacauuuauuaaguaacagauacuuguagaaaauugaguugcaauuguuucucuguauaugcaugagauuaguuccaggagcccccuauggauauaaaaaucuguggaugcucaagucuuauauaaaauggcaaaauauuugcauauaacccauguguauucucccuaccauugacauuaagucaucucuagauuauuuauaaugccuaaugcaauguccaugcuaucuaaauagcuagacuauguauuuuuaaauuuguauuauuauuuauuguuguaguauaauuuuuuaaaaaacauuuuuucugaauauuuuucagucugaauugguugaauuugcagaugcaaaacuugcagauacagggcuaacuauaugucagaagaagggcuuuuauucuuuuuucuuuuuuugguacuuucugugguuagugccuuguacauagcagaaacuuguguagaaagacuugauauguuaagcugucaauacuaccuaaaaugagcugcagauucaagacaguccccaucagaauuauaaaacuuugcugcagaaauguaaagaccaauccccaaauuuguauggaauuucaaggggcuucaaauugcgaaaacaaccuuaaaaaagaacaacaaagucugaguacucaggcuucccaguuucaaaacuuaucacagagcuacaguaaucaaaacagugguacuggcauaaggauagacagagaucaauggaguacaauugaguccagaaauaaacccauacucuuuuuuuuuuuuuuuuuucugagacagagucucguucugucacccaggcuggagugcaguggcaggaucuuggcucacugcaaccucugccuccuggguucaagcaguucuccugccucagccucccgaguagcugggacuacagacgcguaccaccaugucuugcuaauuuuuuguauuuuuaguagagacgggguuucaccauguuagccaggauggucuugaucuccugaccucgugauccacccaccucggccucccaaagugcugggauuacagaaaacccauacuucuauggcuaaguaauuuuuugacaaggaucacauguucagucaauugcaaaaacaguuaaauaagaagaagaaauaaaagacguuccaauuagaagggaaggaauaaaacuaucuccauuuaagaaugaccauuugucuuuucaacaaauaauaaugagacaacuggauuuccacauacaaaagaaugaaauuagauucuuaccuuacauuauauacaaaauuuaacuaaaauggauuaagcaucuauauauaagagcuaaauccauaaaauccuucagagauacagaggcaaaucuucaugagcuuggauuuggcaauggauuguuagauauguuacaaaagggaugagcaaugaaggaaaaauugauaaauuaagcuucauaaaaauguaaaaauuuuaugcaucaaaggacauuaucaugaacaugaaaagacaguguauagagugggagaaaauauuugcaaaucauauaucuaaugaggauuugcuauccaggauuauauaaaggacuucuuaaauucaacaacaaaaagauaagcaauucaauuaaaaaaauaggugauuugauuuaguguauccucaaagaagaaauacaauacugaugguuguugauaugguuuggcuguguccccacccacaucucaucuugaauuguaacucccacaauucccaugugucaugggaggaaccuggugggaggugauugaauuauggaggcgggucuuuccuuggcuguucucaugauagugaaggaguuucacgggaucagaugauuuuaaaaacgagaguuuuucugcacaagcucucucuuugccuacugccauccacaugagaugugacuugcucuuccuugccuuccgccuugauuaugaggccuccccagcuauguggaacuguaaggccaauauaccucuuucuuucguaaauugcccagugucggguaugucuuagcagcuugaaaauggacuaauacagugguccuggcauucuggggaguaucuuaucuuuugaggcuguggcccucuguuggcuuucuggaacuggagccucugcaguauaccuugcuagucuuuuguauuugaaauauuacucugaauacaucugugcuuccugaaggaaauaggagaauuugcauguauucauuaagccauucacacauuuauuaaacaauauauugaauaccuaugaggagucaggcccuauuccuagacaccgaugagccaaacaaaguuguccuuaugcagcauacguucuagggaagaaagacaauaaaccaaaaaaaguaaauauauaccuuuucuaguuggaaacagugcuauggagaauguaaggcagaacuguaaacaugagaaggggagggaagguauauauuuaucugguggugaagaaaagacugacaaguaacauuugauaagagacuucaaagaagugaugugaagugauccuucagauauuuaaaguaagaguauucuagaacagucuuagcaaguacaaagguucugcagugugaguguauguuucauuuaugucaaggagaggcucaggguaucuaaaacccagcaggugugacuuggaguuaaaacccuuaauuccacugaguuuuuuuuuuuucccccaauuuuaaagauggagguaaugauaucugcuuuucuggauuguugaaagaacucaagacagaauauagccacuacuagcacauagugggaacucaguacauagcaacuauuauuauugucauuacuauuauuguaauuagauacagccucagugaggaagaagagaguagagggaagacaucugaacccugagcccaguaguuuagcuucuaaucucugcuuuucuucaguuaauuauuggcccuugaguaacauugaauguugccagauucaaauuuaaucaaauauaaaauaaggguuuuggauuagcugagaauucugaauagcuaugacauacaguaguugcagaaauuguggugguuuaaauaauucaaugcccuugagaaaugguaccauuuuuguaaaaccuguggggucuggaauaaagauccauuucaagcaagcuguuagaacaucugcuuuuauuuccuuguuacaagaauuuugugauacauugucaaacucagauuuuaucuuuuuugcucaaguugcugugaagaacuguuaaaucaguuaauuuuuuucucacuucuacuuugaacaaagaaaaggaaaaucagugucguguuaguuuuccaucugcaaugcuguuacuaaucagcgguauaucuuaaaaccuugcuuuagaauuuagggaaguaaugcauuugccauacaguucauguccuaaagcucauagaacaaaucaucggaccauuucucugagauugauugcugauaaaauuuuuaaaauauugauugaaauauaguucuaaucuagucgauguggcacaaaaauucuagagacaaauauacuacaaagaagucucuugacagucaucagggaaggacacuaggaaauaaaacagaaaaaagcgugagugcacauacacacaaucaugccugcuugaggcgaugucagauaggaauuaauugcuccaaaugaaucccuuuguaaauaucuauuuugauaaggugcuuuuguuaguugguggccccaguaaaggucugcugucauuacuguuauuuguauuauucuuccucuugaaggcaagacuuuauuucagcuuaguuaaaauuauuaauauuugagaugacauuucuaaauuauuaagaauucaguguugguagcuuauaaaaauuuugcauuuaugaauguuaaauaaaugucaggugcaaauaugaauacaaaaucucauucacuaaagaauuuuugaaacauuuguuuuaacauaauacagaaaauaguguugggguaaauguagguagaguugcucugagagagguguguguacauuauauuuguaugaauacauuuaaaaauguauuugaguguaucaauguguuaugcuuuuucucaugacucuuagggugugucugauuguauaccugucuguauuacacaccuauguguguuuauguuuguugggaauucauaacuuaaaggguuuuucuaguuaacauuuuagauguuuugagguaugauguaaagagaugcaaauucuaauuucuugugagguaaggagauuaaauaacuuauuuuucuguuucuuuuccuauccuuuguuuauuuuacauaguucaauagcaaauaaggucuauauuuaaagagccauuagauaguaaaaaccacuguuucuuuuucaaacguuuauuauagccaauuuuuaacauuuaaccaguuuuuuucagaauuaaaauuuaacuaauaauauuauauuuguaugaaaucuuacagauugcaaagugucuucguauauguuuuucauuuaaguauuaacuguuagcccucugugaugauggugauaagcacuuuuauuaugaagauaacccucuaaggcuaacauuuguuaaaggacuuagaauaaguagagaaaccgcucuaucuccacaccuuuuuuuucuuaccucaugguaguauuauggacuugacaaucuugcaaauauuugucugagaagauuuuguuguuuuuguguagucaugauuuaaaaacauucagacaguauggcaggcuauaaacugaaaagcaaaaguucccucauucccacugaaucccuugccauuuccuagucccauucuucagguaaaaaacacugcuaugcuuuuuuuaguacccuuccagguuuuuuauaugugugucuauauaugugcacaugcuuuugugugugucugugggcauggauaagccuguaugugcauauuuuucaccaaguaacuaucuguuuuuugcaagguugcuuuauuuuuaccuaauauaucuuggauauuuuagagauguguuuuaaaaauaaauacaugcuaucgaauaucagagaucaauuuguuuauauuuuaaauauauuucaccuuuauccuuuaagauuuuuauauuaaauguuuauuugagaaacaguauaaaaggguuaugcuaugaauuaacaaaacauguauaguacaucuacaaaacauguacauuacauuagguauuaguguuuuaccugacaugugaaguguuuucugcuauugaaauacauuuuaaauagguauucauuaaaauagaauagaacuacacuaguuaauuaguaccugucagauaacagagguuguuaauaaugguaagucaagguuucuugcuuuuaaaauauaaugaugugaagacugaggucacauuuacuuuaaauuauuucuggauuuaaaacccagaaaugcugauuauuugagggucuaauauaccaauuuauuaaaguaucaagguugaagauuguuccaacccaaagguaaaacuuuuugcuuaaaggaaugaguuuucuccaauuugauucuuaaacccuucuuugccauuugcuuguuugcuuaaggguagcguuguauuugaauacaauaauccuaaaacacuaaaaugaauuuuaacaagauuuuaauccuugcuuugguagacuaaugugauauauuuugcagaaauacacaagcuguaauuaagccuuccucuguaugagacauuuuuuguuuuaguuuucauauuuuaaagucaguuuuaacauuuaauauguggacauaaaauaugaggaaagacuuuuccaaaguauucugaaaguuaaaaaaaauuaccccaaaacugucaaaaauaaagacacuuauuaauaccuuuuuucucccuguaucccuguuagaguuaguucugaaagaggaauuagaguggugccugucuugaaagucaggagauuuggcuucuugucuugguucauagcuaauuaacuguaugugaccuuagaucauuuauuuauucucccuuaucugaaaaaugaagauguuugauuacauggucucuaagguccuuuuaaguucuaaaaugcuaacagucuaugaaguaaguuuuguagcaguuguacaguuuauuuuauuuuaagauucgugaagguauacuaucuauauauguaugaauguuaauaucuuugauuauuuauuuaguuguccaaacauuuguuaaauguuuuuguauucuaugauagauguuggagauauagcagugaauaagacagucauggaccuugcccucauagagcauaguguccccuggagaagaauuaaacaauuauuacauaauuauuuuauccagauaugauauguaacuaugaauauugaauaguagaaugagaagaguaauggaaaaaugaucacagggauacuuggguuauagauugcaaagagagaauagcauauacagaggccuugagcaagcaucuuggaauauuuaaugaauuuugagaagacagaauaccagagugagucacacaauauguggcugauguggcugaugagguggguaggggucaaaucauacagugauuuguaggcaauuuaagaauuuugguuuuuaaugcuaauauuauucacauacauuacuuccaauuaugaccuugguauuacucaacccaguacaugcaaaugcucaugaaauacauuuuuauagagaaacauuuucugucaaucacugcacuaucaacgccgucagguccuugguuucugccuguacccuuacucuugaaaaauguuuuaaaauaugguaaccuaacaagauuuguaaggucaauauaggaaaauuauuuaaugcuuguuaaagucaaauaaguguuuuucauuuuggauuaucaguuauuuuauauuuucaaugcccuuuucuugcccacuaaguguaaugacuugagaauuucugagguauuauuuguuaaaaauuagcaaacuaauacaugagucuuguaguuuaugcuauuauuugccuguugauuugcuuauuucaccacugacuguuuccuuuauuaggagguacuaacauauaaaaaccauauuuguuaauaugcaaauaaauaaucugauauacuuuuuaaaauacauguuuaaagcuuugguuuuuuaaaaaauacuuuuuaaaagaaguuuuagguucacagcaaaauugagagaaaguuagagagauuucccucacauucucuaccugcaguuaugcauagccucuucugcuaucaguguucccucaccagagugguauuacaguuggugaaccugcaaugacaucauuaucacucagaguccaugguuuacauuaggguuuacucucaguguuguacauucuaugaguuuugaaaaauguauuuugacauauaucuaucauuauaguaccuuauagaguauuuuccacugcccuaaaaaucgucugugcucugccuauucauccuucccuuucccuaacuucuggcaaccuccagucuuuuagguagaaucauacaguauguggccuuaauuuuguggggggugaagcaguuaaguuaauuguugauuuuuugaagaacacuucuuguuguuaagaagaccuuuacugacuucauuuuucuucucugagacugguuugcaguaaauauucuauuuggcuauacuaaacagggaauuguuuaaugacaagggagcucacucuuuguaaggcaaugugacagggaugacagguaguacagacacaaaagggaaaugacccauuugcuaauauugaaguaucuuaaauuaguuuaaagauuucagugauuccaaauguguuuuuaguuuuauaacucguauaugcauugauaaagccuucucacuuuuuguagcauaguauuuuuuucuccaggcuggucuccuaacuuuuuucacccaauugaguuaaacaucugugguaugucagaauauacucuuggcacagaucuagguaauuccaauucuuguuugaauggcuucaguaugcucuucucagaagcuuagaacaccccauauaaaaucucauuuucaauucgaucuaaugaguguuuauacaaacuacuauuaucuguuauauauuuuucuuauccucuguguacuugaauguuuuaaaagccauuaugauucauaaauucauggaaacuggauccuaagagccauuuauuuuuucucuuuguuuaguucuguacuucaguuuuugccaguguuaauucauuaauuuaccagauauuuguugaacacuaugaacagaagccucuggcagccauuuauaugaaauauacacaugaauaagacauuauuuuauuuuauuuuuuauuuuuuauuauacuuuuaaguucuaggguacaugugcacaccgugcaguuuuguuacauauguauacaugugccacguuggugugcugcacccauuaacuugucauuuacauuagguauuucuccuaaugcuaucccucuccccuccccccacccuacgacaagccccggugugugauguuccccacccuguguccaaguguucucauuguucaguucccaccuaugggugagaacauguggugauugguuuucuguccuugcaauaguuuccucagaaugaugguuuccagcuucauccauguccuuagaaaggacaugaacuuaucauuuuuuacgguugcauaguauuccaugguguauaugugccacauuuucuuaauccagucuaucauuguuggacauuuggguuacuuccaagucuuugcuauggugaauaguggcgcacuaaacauaugugugcaugugucuuuauaguagcaugauuuauaauccuuuggcuauauacccaguaaugggauggcugggucaaaugguguuuucuaguucuagaucuuugaggaaucgcgacagugucuuccccaaugguugaacuaguuuacagucccaccaacaguguaaaaguguuccuauuucuccacauccucuccagcaccuguuguuuccuggcuuuuuaaugauugccauucuaacuggugugagaugguaucucauugugguuuugauuugcauuucucugauggccagugauaaugagcauuucuucaugugucuguuggcugcauaaaugucuucuuuugacaaaugucaguucauauccuucgcccacuuuuugaugggguuguuugauuuuuuucuuguaaauuuguuuaaguuccguguagauucuggauauuagcccuuugucagaugaguagauugcaaaaauauucucccauucuguagguggccuguugacucugaugguaguuucuuuugcugugcagaagcucuuuaguuuaauuagaucccguuugucaauuuuggcuuuuguugccauugcuuuugguguuuuagucaugaaguucuugcccaugccuguguucugaaucauauugccuagguuuucuucuaggguuuuuuuuuuaugguuuuaggucuaacguuuaagucuuuaauccaucuuuaauuaauuuuuguauaagguguaaggaagggauccaguuucugcuuucuacacauggcuagccaguuuucccagcaccauuuauugaauagggaauccuuucuccauuucuuguuauugucagguuugucaaagaucagaugguuguagaugugugguauuauuucugagggcucuguucuguuccauuggucuauaucucuguuuugguaccaguaccaugcuguuuugguuacuguagcccuguaguauaguuuggagucagguagugugaugcguccagcuuuguucuuuuugcuuaagauugucuugggaaugagggcucuuuuuugguuccauaugaacuuccaauucugugaagaaagucauugguagcuugauggggauggcauugaaucuauaaauuaccuugggcaguauggccauuuucaugauacugauucuuuucuauccaugagcguggaauguucuucuauuuguuuguguccucuuuuauuucauugagcagugauuuguaguucuccuugaagagguccuucacaucccuuguaaguuggauuccuaaguauuuuauucucuuugaagcaauugugaaugggaguucacucaugauuuggcuguuugucuguuauugguauauaggaaugcuugugauuuuugcacauugauuuuguauccggagacuuugcugaaguugcuuauuagcuuaaggagauuuugagcugagaccgaugggguuuucuaaacauauaaucaugucaucugcaaacagggacaauuugacuuccuguuuuucuacuugaauacccuuuauuucuuucuccugccugauugcccuggccagaacuuccaacacuauguugacugggaguggugagagagggcaucccugucuugugccaguuuucaaagggaaugcuuccaguuuuugcccauucaguaugauauuggcuguggguuugucauaaauagcucuuauuauuuugagauacaucccaucaauaccuaguuuauugagaguuuuuagcaugaagggcugucgaauuuuguugaaggccuuuucugcgucuauugagauaaucaugugguuuuugucuuuguuucuguuuauaugauggauuacguuuauugauuuguguauguugaaccagccuuggaucccagggaugaagccaacuugauucugcugcuggauuugguuugccaguauuuuauugaggauuuucacacugauguucaucagggauauuggucuaaaauucucuuuuuuuguuaugucucugccaggcuuuguuacaaggauaaugcugaccucauaaaauaaguuagggaggauucccucuguuucuguugauuggaauaguuucagaaggaaugguaccagcuccucuuuguaccucugguagaauucagcuguggaucugucugguccuggacuuuuuuugguuguuaggcuauuaauuauugccuuaauuucaguaccuguuauuggucuauucagggauucaacuucuuccugguuuagucuugggagggugugugucuaguaauuuauccauuucuucuagaguuucuaguuuauuugcguagaaguguucauaguauucucugauggcaguuuguauuucuguggaaucaguggugauauccccuuuaucauuuuuuauugcauuuguuugauucuuuucuucuuuauuagucuugcuagcagucuaucaauuuuguugaucuuuucaaaaaacuagcuccuggauucauugauuuuuugaaggguuuuuugugucucuaucuccuucaguucugcucugaucuuaguuuuuucuugccuucugcuagcuuuugaauuuguuugcucuugcuucuccaguucuuuuaauugugauguuaggguguccauuuuagaucuuucuugcuuucucuuguggguauuuagugcuauaaauuucccucuacacacugcuuuaaaugugucccagagaugcugguauguugugucuuuguucucauugguuucaaagaacaucuuuauuucugccuucauuuuguuauguacccaguaguccauucaggagcagguuguucaguuuccauguaguugugcaguuuugagcaaguuucuuaauccugaguucuaauuugauuacacuguggucugaaagacaguuuguuauaauuucuguucuuuuauauuugcugaggagugcuuuacuuccaacuauggucaguuuuggaguaagugcgauguggugcugagaagaauguauauucuguugauuuggaguggagaguucuguagaugucuauuagguccgcuuggugcagagccgaguucaaguccuggauauccuuguuaacuuucuaucucuuugaucugucuaauguugacagugggguguuaaagucucccauuauuauugugugggagucuaagucucuuuguaggucucuaaggacuugcuuuaugaaucucggcguuccuguauugggugcauauauauuuaggauaguuagcuuuucuuguggacuugaucccuuuaccauuacuuaauggccuucugugucucuucugaucuuuguugguuuaaagucuguuuuaucagagacuaggauugcaacuccugcuuuuuuuuguuuccauuugcuugguagaucuuccuccaucccuuuaauuugagccuauguuugucucugcaugugagaugggucuccugaacacaacacacugaggggucuugacgauuuauccaauuugccauucugugucuuuuaauuggagcauuuagcccauuuacauuuaagguuaauauuguuauaugugaauuugauccugccauuaugauguuagcugguuauuuugcucauuaguugaugcaguuucuuccuagccucaauggucuuuacaauuuggcauguuuuugcauuggcugguaccaauuguuccuuuccauguuuagugcuuccuucgggagcucuuguaaggcaggucugguggugacaaaaucuuucagcauuugcuugucuguaaaggauuuuauuucuccuucacuuaagaagcuuaguuuggcuggauaugaaauucuggguugaaaauucuuuuuuuaagaauguugaauauuggccccaacucucuucuggcuuguagaguuucuccugagagauccacuauuagucugaugggcuucccuuuguggguaaccugaccuuuuucucuggcugcucuuaacauuuuuuccuucauuucagccuuggugaaucugacaguuaugugucuugagguugcucuucucgaggagcaucuuuguggcguucucuguauuuccugaauuugaauguuggccugccuugcuggauuggagaaguucuccuggauaauauccuggagaguguuuuccaauuuggaucuauucuccccaucacuuuuagguacaccaaucaaauguagauuuggucuuuucuuauagucccauauuucuuggaggcuuuguucauuucuuuuuacucuuuuuucuguaaacuucucuucucaguuuauuucauucauuugaucuucagucacugauacccuuucuuccacuugauccaaucaacuacugaagcuugugcaugcaucauguaguucuugugccaugguuuuccacuucaucaggucauuuaaggucuucucuauuuauucuaguuagccauucgucuaaucuguuuucaagguuuuuagcuuaugugcgauggguucaaacauccuccuuuaacuuggaaaaguuuauuauuacugaucuucugaagccuacuucugccaacucaucaaaguuauucucuguccagcuuuguuccauugcuggcgaggagcugugauccuuuggaggagaagaggugcucugauuuuuagaauuuucagcuuuucugcucugguuucuccugaccuuugugguuuuaucuaccuuuggucuuugaugauggugaccuacagauggguuuuugguguggauguccuuuuuguugauguugaugcuauuccuuucuguuuguuaguuuuccuucuuacagucaggacccucggcugcaggucuguuggaauuugcugcaggucaacuccagacccuguuugccuggguaucaccagcagaggcugcagaacagcaaauauugcagaacagcaaauguugcugccugauccuuccucuggaaccuucgucucagaggggcacccagcugugugaggugucaguuggccccuacuggaaggugucucccaguuagucuacucaggggucagggacccacuugaggaggcaaucuguccauuuucagaucucauacuccaugcugggagaaccacugcucucuucaaagcugucagauggggacguuuaagucugcagaaguuucugcugccucuucuucagcuaugcccugcccccagagguggaaucuacagaggcaggcaggccuccuugagcugcagugggcuccacccaguucaagcuucccagccgcuuuguuuaccuagucaagccucagcaaugguggaagccccucccccagacucgcugcagccucacaguucaaucugggacugcugugccagcaaugagcaaaacucugugggcaugggaccugaugagccaggcaugggauauaaucuccuggugugcaguuugcuaagaccguuggaaaagcacaguauuauggcaggagugucccgauguuccagguacugaccgucauggcuucccuuggcuaggaaagggaauuccccgaccccuugcacuuccccagugaggcgaugcccugcccugcuucagcucacacuccaugggcugcacccacuguccaacaaguccuaaugagaugaccccaguaccucaguuggaaaugcagaaaucacccgucuucugcguggcucacacugggagcuguagaguggagcuguuccuauucggccaucuuggaaugaucuccauuacuuucaguccaaggaacuuacaggacuuuaagggcuuuaaaggcauuaagaaaaguuuguaaauaacauacaaagugaaaaaugcuaaaacgcuguauaggagaguuuagaggaagguagaauuacuuguuucugagagagaaucugugauagauucuaccaggaagaagaaggcuagacuuugaaauauagauuaggucagauauguacagaugggaaacauguuauuuauuuguagcaguggcucaaaauaaauaaagaauauauguggaaaagcacuauacuuaugagaggauccaauuugucuaauauugaaugggaaguauguggaaauaaaacaggcagaguugcuugggaugagaucacugaagggccuucaaugcaguuuuuauauguauauucaaauauaaauccauguuuaugaauauaauaaaugcauuucaauuaaaaaaaacugugauuguuauuuccaugcuguugaauauaugccagaggaaggguuguaacuuuuuacugaauuguguguagcuacuguuaaauucagaaaaauuuuucuuaugaaugcugauguccagcuuuuagucauuuauucuuuucaaaauuuuucuucaugauaaaagaaaugcauacauacucagucuuuuaaaaaaguuuagaaucuacaggaaaauagaaaaaaaauggucaucuguacucuaacauuugcauuugguguauaauauuuacuuuugaaaacauuuuuaaguggaacagaggauaacaagagguagguuuuuuuuucuacuuggauaauuuagaacugauaaacuguuggcuucccuacuucuguuuaucuuccgguguuaguuugauaaacaacuuuaaaucuuugacuaaaaucucaaguuuucauuuaaucagaauguauugguuugaggucacuugaaaacagaguguauacuucaguuuguaaaacugaaaaaagguaacucaguuguuauuuuuauuccagaaacauguucauuuuauuuuuuuaaacugcauaaaagguuucggagaaauauaaaaucuucaguaagaagaaaaauuuucucccauugaacuaugaagaguugugguaauuuggcauuaucagcauacacucaguuauguuugcaaucucaugugaagaaaaaaacgcaggaauugcagagcuacaauaccugguuagggcaagagauuuuuagaaaaggcaaaauaaggucuuucguuugauucauagacaguuuguuuugggagggccugcuuugugccaaguccuguaaauacagagcagaauuagaaaugaccacuaucuucaguaugcucucaguccaauuauuaaaucugaauagaggauugugagaauugacaccaggcccuuguaugugcagagcacacugugguaaugcagaagacuuccacuugauagaguuuuaaauuauugaaggaagaugaccaaaagcccagacauuuugguguaucuuaagguuucguuguuaaaauuaagggaguaagacaaugaaaaauauauaugcagcaaugcaaaacucuuuuaguauuucuguuuuaguauuuggaaaauaagaaaaggaaauuuaaagaaugagagaggaagggauaaauggagaauggcuucuuacuacuguuacaaaccuaaguagaaagaaaauaucuuuguucuuauuaguauauaaauggaaauuucuuauuauguccaugcccuguauuuguaugcacauauauuaguuuuguaauauguggaguuuuugcacugucaugccuuucucaauguaguuucucaacuuugagauuuaguuucauuuaaauuccauccuuauuacuauuggaacaucugaguuucacuacauaaaacuuucuuagugauuuagcauuuuccugguccaugaagugggacguuauugucaucuguggcuauauuguagcuguagauguugaagauguuuuagaggaagugguagucuaaauaauguauucagcaaguguuaaacaaguuuagguuaaccaguuuucuacuuuauagagguaauuuuuauucuaaacauaauaauauaaauaaggauuuauaugacauuccaaauuauacguauuuuggugauugauucaaaaacuuuuuuuuuucuauguaggacaccauugcaguggcuagauuuauuguuuuuuuagcuucuucaucuacaagcagagaugguaaaccuugcauauuuuugaaagcauuugaagaccucaaaucaacuguuuauguaaguaugcagcuuuuauucucuaauuacauugcagauuuaaugagcuaaagugaugggauugaaaguauuucuguaaaucugcagauaaacuacuuggucugacuaaauuauuuuaauugaauauuuuaaguuuaaaaaauagaaguuuuuuuuucuugguuuuauuuuucgaaugacaagauagaauagggaauuccuuuauauuuaauaaauacuuauuaaugaaacuuacaaaaccgcacagacauucuagacuggauauucuuugugauuaugccaucaggcacuuuguucuacuugauuucacuuuaaauuaaucaacuaccccucuuuagguaaaacggauuuuuuccuucuccuacuuuauucguugugaagauggccuuccucuccuuuccucuuuuaacacccuaccuuccacacacacacuugaaaacugccuuuuuagucaaggcuauuagguagaauugggcuaagccaaaagccugcaggccaacaucugccuuuuuuuuucuaguaugcacaaagguacuauaagcacuggugguggcucugcuugauauuaaaauuaaugaauuaggcuggagauggguaaaauuugcaguuagagugaucacugaagcacuuccuuauugauuuuuuucuuucugaaaacaucuaagguucuaugcaggaaaaauuuugaauaucagcucugauuuuccacuucuauuggacugauaggaguuggcauucuuuuacauucuauccugagaacuguccugagaacugaauauugcugugcuucagauuuaaucuguaagaacacuaauauuuuaauaaaguacauuuucauuugaccuuauaucuuugccuuuuuuuuuuaaguuucuguagcuuagacaacuuugcacauuucacuuuuaauuuguaagccauaacuuuaugucauccuagugaauuugaauauuuuacaaguaaguguguacuuuuacuacaacuaaaagcauguaaucacauuggagguuaucuguauacaaauaaguucuuucuuuuuuuccuucagguuuaugucaaaucuuuaagagauuuuucuacagaaucaaugucuuugguaagaugauauucaguuuaauuuagaguauuacaccuauaccuguauaugccacacacauagauacauguguauguauauucaguccacuuuguagucugauauugauauauuaucaauacacuggaaaaacauaaucuuuacuuuuuuauagcugauaauguuauauuagaguuauauauuuuaccuaguaaucaauaucugaauauucuguugucuggaauaucugcugauauuuuguguaagcuauacauacacaagaaaaauaaaauaaguuuuuacuguaugaagauccuuaaauuuuuguuauaaaccauaggcaaauucauuucuuuuuacauuagcuuguauuuaaccagacaauuaugugcugaauuauauaauugaacaaauuauauaauuuuaaguaguuuucuuauacuuaugauacauuucuuuuuaaccauuuuccccacuauuuuauagcauagauauagcuauagcuuccuuauagcaauaggaagaugcccauucccauuuuuacagauagucuacuuguagccgagugaaacuggaaagaagguguuaauaauuuauugguauaguuuaauaugauguuuauguucuacuuauguuuuugaaccuuuaguuucaaauggacagaauucaggaacuguuucugguugacaaugacuguaggacacaguuacuaaauucugaguauuaguauaauuaauauuuuugggggaacuguuaccaauaaaagaacugauguacuuuuugaaaaaugugaguuagcucugguauuaguauuucccaaaauuguuauaaauuguuuaauuuaaaauauuugauauaucugcgaaccuguaaauaaggcgggaauaaaugaaaaagccucugaacuuugcaaaaauauuuuuucacaaagccuagguauuguaaguuaaaucaagcauagaucuauuugacuuuauuuuccugacucaucaaaagaugcuuguuuuuacauuucuacauuuuuaaacugagcauggaucuugcaguugauaucaagaaaacggaguuacuguuuuugaguuucuuguuuuccugaaaaaguguauuuuuuugagaauauaguauuaaaaguguagucuaugaggaccaggguguuuuuagaauuuagaaaauagaguauuuguuuuucagugguagaaaguuugcuuuucaagugacucaggguaaucauuugaucuuguauugucuucaggauuuaaaagcuuuacuagcccacuuaugugaucugaaggcccaauauaaacuauccccuauauuuuuauucaaccuaaucuugucauuaccuuugaccaguacacuccagccauccaaaccuccuggauuuucaaauauacugaauguguuuucucugcuuggaacacuguugcuuaucucauucccaacuucuguacuucauuuaauuaguucuuucuuuaaauaucuuuucaaauagaccuucuaagacaauucuaagacaucucuccgcuuuuaugguuuguucuuccauuggugcagggucuauuuguguuuuguucacacuuauuuuuagugccccguauaguacauagcccaucaaugaaugaaugaaggaaggacagaaauaaauaaaggaaugaaugaaucgaauuaugcugcuaggugucuuucucucuucaggcuuuuauugucugcugugcuugauuuuuguccgcuaguuaacuuucugcauaugcuguaaauugcaucucauuuaaccagggcucacauuuuccugacugauugauuccauaaugggcugccccuuaagcagucaaaaaaaaaaauuguucaugucugugugaaauguggaucaagugauguacuuaaugauaaugcuaucaaguuaucuuuaguauaucaugagccgaugguuuucucauggacauaugccugugcugugcgauaaugagcaacuagcuguguguggcuuuuaaaaauucaguucaugauuugcacuagucauauuuaaauuccugaguagccacaauauugauauagaauauuuucauuaucauagaagauuaucuuggauaguacuguucuagauuauuuagugagcaauaaaaacccucaacaaguauuuuuguaagugcuaguuuuauuaaccuaggaguuguuaggaugucauaaauauuauaugccuguugcuuuagauauuagccaugugccuuuugcaccagcagugugaaacuauuuucagaucccugauuacauaaugcuaguauaugcuaucauuucuccuuguuacuuguccuucaaaauuuagauuuuguugccaccuucagaaagccuuugcuuaccauucuccuacuaacuacacuauuucucccgcuaacacauuuguucacacugauuuggaugucccucuacaguccuuuuuuauggaauacaauacuuuauugugucagcaagggaggcaaauuggcuacuaagauagggcuuauugggaaucauguaaauuuaauuaccuuguugaagugugagcuuacucaaugguacauuaaccaaacuuguaagaauauuaacccaacucauuagagaaugauuaagaagcaaaaaauaucaauuuaugaauuuauaaugagguuuauaucuuagcuguuguacacauaaauacuugcugauuugcauggaaagccaaacaagaaguuguuuauugguaaugaauuaacaaauggcgguuacuugguugauuauaaugguuagugucauugaguuuugcuggccuuucccauucaucucuccaugagauguuaagauagaauauugaguguaagcuaagcacauguuuucucccuacuguucaguaugcuucucuuccauuauuucucuuuccauuccauuauuccaucauucuuuuuuuaaucauugaugagcuagcuuucuuuauauugaaguuugauuagauuagcaaauucuacucuuguuuaaacugagaagccuccuuggaaaaacuaauuuuuuaauuugaguuuuaaaauuuuaacucucagagugauagguauccuuauuuccauuugauguugggaucacuuauacaaagcccuuuaaggcuuuauuuaguaucacuguuaauaugcaaacauguccuuguaaaccacuuucccuuuucuuucccaacuuauucacaguuauuucaaaaaauuaucuuuugguucucuuauuauuauagaacaaaaggagcucgcuaccugauguguuauaagccaauacugugaaaucaaauuuuugagaaaagaaaagcugaaagucaacaccuaaggagacacgagcugagcucaaauaugucucccugcgcugucuuuaaggcaguaauuuuauuagaaaaguuuuaaagaguagauacugggauuaguaagucauuaguuggaugaaaggggaaguuuggaaaguccuugggcaagcauaguuauuucuucacauuaaugcauggguugcaugugcaaauucagguggaguuaguaugaugaaugugauggaaauucauacugugauaucagcagacucguucucaaauuccagucagccaucuugguuucaacugauuucagauaguuuuuuccugcucucaaaaucaguaggaguuucaguaguaucucagcaaguuguuucuuuucuuaucugauauucugcaagcucaagaauuuguguuaguugcugauuucaacuucucaauaaguuuucauuucuuaucuacuauacuguaagcccaagaauuuaggaauuguuaguuuuaauucuuugggguaggguuucauuauuagcauuuuaaaucuuuuuauaccauuuaugacucaaaaccuggcuugaguuaugagucaaaauuuaggccuauggaaaaucucuauaauagcauggggguaaggggaagagagaaauuguaccacaaguuucaaagagauauuaguuaaaaaauagaaccaaaaucucuuaaauugcauuuuuuagaauuugcucucuguuaacaguuugauuuauugucccccagcuacaguuucuugaccaaauaagcuagggauauacuaacuuaaagauagcuaggaugauuuaauuacuaaaagauuccuugagaguguccuuaaaaaaaaaguuuucuaaacuuacaagagauguaacuuguauuguuaagacuaguguucuaguugcauuuucagggcuucuaaaaauaucucuuuaugccuagucauuuaccuuuaauaaaacucucuuuucuuagaccuuuuacauugaagauguacauauuuaaaaaaaaguauuuucuuguuuuguguuauugcuucaguuuugacauguauugcuguuuuucacuacagaugcuccuugauuuacaaugaaguuacauccaguguacccaucauaagucaaaaauuuuauaaauacaaaaugcauuaaauugccuaauagacccauucuaaagucagaagauuguaaguugaaccaucauaagucagggacuauauguauaugcuguuugcuauguuuuuauugaagaaguauaauguuuuaauuagauuauagguuaugccuuuaugagcuagugugcaaauuguaccauuuauaaacaaaguucuaaggaaaacuaguuggauaagcuaagcugugugcauugccuuauuucagguuauaacuucuuuuagacacuuaaaaggauaaaauaguuacauggauuugcugcuaauaugauuauaacaugauucuacaauguaaauacuuuguauaaauguauucacugucuucucuuucuuuagguuccagcaacaaauuauauauauacaccccugaaucaacuuaagggugguacaauugucaaugucuaugguguugugaaguucuuuaagcccccauaucuaagcaaaggaacugguagguauuaaaacugguggaguuuuuuggaguggaaaugcauuauugauuuaggaacacgguuccaucuguacccuaaguccuagaauagaagcucaguucugaccuauaauugccaaacaacacugaugcauauucuuuggcuaguuuaauuuguaaaauaaacgugaucuuuagauucuagagucuaguuaaagacaguaaggacaaagaaugaagcaaaggaugccaaacagcaacgugaaaccauaugaaaauauaaaauucacuggaaaagguaaauauauaaacaaaugcagaauacugcaauucuguaacauugaugcauaaaucacguuuaauucuguuauagaaguugaaaggcaaauauauaaaagcuauaacuauagaaauauguuaauggauacauaguauaaaaagaugcaaauuaugacgucaguaacaugaaguguggugggggguagaaguaaaaguguagaguuuuuguaugcaauuaaaguuaaauugucagguuaaaguagauugcuauaaauauaagguacuuuauguaaaccccaugguaaccacaaagaaaauaccuauaaaagauacacaaaagaaaaugagaagggaaucaaagcaugucauuacaaaauaaugaaacacaaaggaagauagcaagagaagaaaauagggaauugagugucacaagacagauagaaaacagugaauuaaauggcaaucguaagaccuuccuaaugaauaacuacuauuauuauaaaugaauuaaauuaccuaauaaaaaaucauagaguagcugagugcauuaaaaaaaacgagauacaacuauaugcugucuacaaaaacucaccuuagauuuaaggacacacauaggcuaaaugaaagugaaggaauggagaaagauacuucuugccaaugguaaccaaaagaggagaaguggccauacuuacaucagacaaaagagacuuuaagucaaaaacugucacaacaggcaguuuuuggauaucacauaaugauaaaaggguuaauucaccaagaaaauauaacaauuauguaugcugcuaacaucagagcgcuuaauccaugaagcagacauuucagaagugaagggagaaauagacagcaacacaauuauaguaggagguuucauuucaccacuuccaauaaugggggagaccauccagacagagaucaauaaggaaacagaaaacuugaacaacacuguagaccaaauggaccuaacagacguaucagacauaugcagaauauucuacccagcuacaacagaguauacauuuuucuuaagugcacauggaacauucuccaguauacauaacucguuaggucacaaaacaagugaauaaauuuaaaauagcaagaucuuuucugacuucaauaaaaucaaacuagaaaucaauagcaggaggaaaauuauaaaauuuagauguguggauauuaaacaauacacucuugagcaauuaaggaaacuccaugcuguuuuuuauaguguuuguacuaguuuacauuaaaaaauguaugcaccuugaugauaaauacaguauugcuaaaaaaugcuaaggauaaguugagccuucagcgaguuaucaucguuuugcugguggagaugauagguugauuggucaggauggaguuuucugaagacugguguagcugugacaguuuauuaaaauaagacaauacugaaguuucucauaucaauugacucuuccuuuuacaaaagauuucuuuguaacaugagaugcuguuugauaguauuuuauucacaguagaacuuauuucaaaauuuuaguccuugucaacccugcugcugcauuaucaacuaaguuuauggaauauucuaagucuuuuguugucauaucaaaaauauucauaacaccuuuaccaggaguagauuacuucuuaagaaacuaucuuuccucauccauaagaagcaacucuucaucuguugaaguuuuauuaugagauugcaccaauucagucacaauuucaggcuccauuuauaauucuaguuuucuuacuguuuccaccacaucugcagugacuuaauuccaccaaagucuugaaccccucaaagucaucugugaggguuggaauuaacuuuuuccaaaccccuguugauguuggauuuugaccucacaugaaucaugcauguucuugaugucaucuagaauaaauacuuucuagguuuuuaauuuacuuugccgcaguccaucagaaggauugcuaucuaugguggguauagccuuauaaaagguauuuuuuuuaaauaaugacacuuaaaaguaaaaauuauuacuugauuugugggcugcagaauggauauuguauuagcaggcaugaaaauaacauugaucuugaacaucuccaucagagcucuugugugacuaggugcacugucaaugagcaguaauauuuugaaaagaaucuuuuuugcugagcaguacgucucaacguugggcuuaaaguauucagaaagccaugcugugagcaaugucauccaggcuuuguuguuucauuaaagagcacaggcagaguugguuuugcuaauuuugaaaggcccuaggauuuugagacuaagugaguauuggcuucaacugaaagucaucaacugcauuagacucucacaagagagugaaccuguuuuuugaagcuuugaaggcaggcauugacuucuccauaguugugaagguccuagauggcaccuuguuccaagagaagacuguuugguuuacauugaaaauguguugguuuguguagccaccuucguugaugaucuuaggucuucuggauaacuugcuccaucuucuucaucagcacuugcuacuugcuguuucaccuuguacuuuaucuuaugaagauggcuucuuuucugaaaugccaugaaccaaugugauagcuucagauuugucuucucuagccuucccaccucucuuggccuuuaaagaauugaagagaguuagugccucauucuacuuuaggcuuuggcuuaagggaauguuguacugguuugaucaucuaugcagacgacuaaaauuuucuguguaucagccauaaggcucuuugacuuucuucucauucauguguucacuaaaguagcaccuuuaauuuccuucaggagcuuuuucuuuguauucacaacuuggcuaacugggcacaagaguccuaguuuucaguguaucucagcuuuggauauaugccuuccuaagcuucaucauuuguaacuuuugauuuaaagugagagacaugugacucucucacuugaacacuuauaggccauuauaggguuaucaagucaucuaauuucaauauuguuguguuucagagaauaaggagccucaggagagggagaggggaaugacagguugaugggggaguuagaauacacauauuuauugguuaaguacacugucuuauaugggugugauuugugcuaccccaaaacaauuauaauaguaaugccaaagaucacugaucacagaucaccauaacagauacagugaaaaugggaaagucugaaguauugugaggauuaccaaaauguaacauagacgcacauacuguugcaaaaauggugacaguagacuugcucaaugcagaguugccacaaccuuuaauuuauaaaauugcaguauuacaaaguacaacaaaguaaaguacaauuacaugaguuaugccuuuauuaacauggucauacuacucagucaucucagauucaauguauucccuaucaaaauccaaguagcauuuucuauagaaaaauaaaaaucaaucuucaaauucauauggaaacacaaaggacccugaauagccaaaagaauccugagaaagaucaaaccuggaggcuucucucuuucuaauuucaaaauacguuaaaaaguaacaguauugcgacaguaugguacugccaugaagccagacauacugauuaauggaauugaauagagcgccuagaaauaagcccacacguuuauuauggucaacugauuuucgacaagggugcaagaauauauaauggggaaaguauagucucuucaccaaauggggcugggaaaacuguauauccacaugcaaagaaauuggauccuuagauccuacacaaaaaaaucaauucaauguggauuaaagacuuaagaguaugaccugaaacugaauguucuggaauaaaacaggggaaagguuuccuggcacuggcccuggccaugauuuuauauacauauauacauauauaugaacugauacagagguguauauauauuuggauaguuuuaaaaguaaaguaaaaauguauaaccuauuaauugcuauaugauaauguaagguuuuaacaaacauguaaacgaaaacaucaaaagccaugaauuucaguuuauugugagguaauaaagugaacagaaacacacacuucaccuguguuuaauuuaauuuuacuaaauuuaacauuguuuauuguauuucaucuauucuaaaacaccauuaucuguaaaaggcuuuaucauuuuauguaucauucagaagggaaaaaugcuaauuaaacuaugcuuaacugucaauuuuaagauagagccguauuucagagauguuaaauagugaaacauggauguuguugaugaaauguagacuuuaucuccugcaugccaggaguugugaucauguugcaaacacaaagauguucucauugacuucauauuacaaaaccauuuuuaaaauaaagauauacaaauuuuauuguugaggaaugaacuaggaaucuacucuuuggucagguggaugugggaaaaucuuuuucuuguggucagcauauuuuauuaacguauaauguaaaaaaaacuagucuguguguaaaugaacauugcgaagacuauuaaauacggagauaaguuuuaaauaaaccucauacuaagccugaagacugcaaagaauguuuuguggaaaauccuuuuaauaucuguuguuguagaggaaaggggaacauuaaaguugaaguagagaaauuugugcuugaagaccuauuuuucaaauauucucauuucagcuuauucccagagucuucauuuccccaccccaucauacuguucaacauaaacucacauacuuuucccuuaguaguuuccucuccccaucaauuuucuucaaauguuacgugugcugccccuucugggaguuagccauaaagauguaaucacuaugauccucuucgaauuugaaguuuuaccugguugaauuuaauuggcccaccaaacuuaggaauaagcuacauuguugcuaauaauguaucuauagaagauauaauuuaaaaaguuuuuuuaacaaguugaucugcaaauacaucauuuuaaaaaaaacuuaaaauaugauaauauagacuaaaaugauagcucuguuaaaacauugaugacaacauuaauuuucaguuguuauuagaaaaaucauguuuucucaugauaauguuauuaaaucuugcauauaaaaugaaagccauggggaacaagaauauguauuauauuuucauaugugucuuauaucucuaucagauauguuuacuucaaucacugcagucccguaguaaaaaauucauggcuaguaaugagccaucuuuuauuaccaagauaauauguuuguuucuucuaagauacuaaauuaaaaugaaugucaucaauuuuaucugaaccuggucguugaagcuuuuaaauaaaucuuaagacauagcaagaugucuugacuacuagccagacaauaaaguuuuaaaacucucucuaguaacuucaguuacaguuauauuagagaaauagcacugauauuuguguucaggaaaagauaaccuucauuaguauuaccacagagaaguacaagaauagauguacaggaacaguccacagcugugccuuuuaaaauauuaccuaaagcaguacuuuuucacaaauacagggcuacaaucuaaauaacauccagauguauauagcuaguuaugugguggaaaauuaccuuuaugcaguucacauuuagguagauggaaaaaguguauucuguuacauaucauuagcuagaauuuuucgugaaaauucaucuuauaaauguucaauucagugugauagaagcaauuagcaauuuggcaucuuuacuccuugacagaaauuuuucuuugcucuuauccugaauaaagauuacauaugaccuguagcaugcuaucuuauuucugguagaaauccuauucugguagaaaugcuucuauuccuaaguucauauucaccuuuggaguaaaguuuuaauuuuuacauagagucuaucagaacuaucagaguuaaaagaacauauaaugcuauagauacuaacauuccuauucaguuuugauaagauuaaugaugaaaacugagaaagaauuccucacauauuuuagaagcaacauauauugaaauguccuuuuaucaucaaaauuuauuuuauaugauuuuauuuuuauuuuuauuuauuuauuuauuuuugagacggagucuugcucugucacccaggcuggagugcaguggcaugaucuuagcucacugcaagcuccgccuccuggguucacgccauucuccugccucagccuccugaguagcugggacuacaggcaccagccaccacgccuggcuaauuuuuuguauuuucaguagagacaggguuucacuguguuagccaggauggucucgaucuccugaccucaugauccaccugccuuggccucccaaagugcugggauuacaggcuugagccaccacacccggccuauuuuuuuaagagagacagggucuugcucuguugacuaggcugcagugcacugccgagaucauagcucaccucagccucgacugcugggcucaagcaauccucccaccucagccucccuaguagcuggaacuagcagcaugugccaccauguccaacuaaucaaaaaacuuuuuuuuuuuuuuuuuuuuuggagagauggaggucuugcauuguugcccaggcuggccuaaaacuccuggucucaagcaguccuucugccucagccucccaaagugcugggauuaccggugugaaccaccauaccaagcccaaaauugguuuugauaaugacucaucaaugauacguacugugcuucuuucauauaggaaaacaaagucauugccuucuuuaagacuagagauuuuauagcaauaauuuucucugaaaaccuuaccuauacuuuugcuuugggagcuggcuagauaguauuagguaugcaguuuuugccguggacacauaccauucaucauauuuuccuagauaacacauauaagggaauuuaauuuuagcuguguuucaguuuuuuagaaauagcuauuuuuuaaacuugagacacauuuacucuguuuuuauuaucugcucuuacaaaauaaaacaaauguauucagaccauaaaacauuuccagacuuguuaauaguguauggcucauccuugcuugaucaauaucauaauuccuacucacaacgugagcaaauaggaaaaauagagggaaccuuguuugugcuuaaucuccuaauauuugaauuuagaggaagggagaggcaaaauauucauuguuugccucuccuucuuuuuguucuuuccucaaauuuugaguccuucuuucuuuuauuugcuagagaucucucauccuuuuugugccacauaaugugguacaucaccugugggcucacuaccuuaccucagguauggucuguuccaaaauuacuuguuucucuuacccuaccucccauuaaaacucauuuuagaaaaguaguuuguuuagcagucuuggauguuacaguguuucuagaagcagaucuuucucucuuccuguucacugucuuacaaggacaccuucuguuuuagcuacuuacugagcaguauaaucaaauuucucagaguagcauccaaaacacuggauucugagagccucugucaguuuuguuugcuuuuagauuuugggauaggaugcuaggauauggggcccuaacauuuuuuucuuuuccuguucuauaaaaacaucccagcuaacucuagaaugcuguuuuuuguuauguaauauugauuauuuucacaucugagaaggacaugucauguacauguagugucauguagcauaauuguuuuaauauuuugguuuuguguuagcaauacugguugcacauuaaaugaauauauauuuugcguuuuaauuuuuaaaaguauaacaauguacuuccacauauccggaauugacauaguugaaaaugucaacuauguauuauugauacacauauugauauuaauguauuaauuacugaguaauuaaucacucauuguuacuucauaagaccuaggagccuucugauuuaucagagagaugaaagaaucuaguaugauguaaaauuauauguaauaauuauuuaaucuauuuuucaauuuuuuuuaauugaaaaugcaccuuuggcauuuuaaaacaaaaaagccuuuugcagucauacacaugugaugacaaguuauagaaccuauccuagaaaaauauacaacacauacacguauacagacuuaugcauauaucuaugguucaugcuucucccacuuugaacuccauguuguuaacucaugaccugugauauguucauauucacuuaccugaauauuuagauaauauuagaaccguaagguuguccucuuuguuuaauguauggcgcauaaaauaaauaaauauauaguuuuguauuucgguucacucauuuguuuguucagcaaacugcuuauuuauuuucuauaugccagauaauaugacaugggaaauucaaaguuauauaugucauuguuucugacaagggauuaaauuuugugaagacagauaaauuaaugaauaauuacaauacaauuacuauaacuauuaguuacauaaacuuuuuuuuagucuuuccccaauugguaaaacucuacuuuucuguuuuuuggcuauguaagauagaaccuucauuugugaaagauaccaugcuuuuugaauauauauuuucaaauugaaugaugaguuaccuguuacaaugaauggaguugguggaucagacagacacugaguuuuccauuucucaggagucaaaaaauaaauaugucuaggugagugaggggagacucuucccagaugcuuaacugccuuucagaaauggacucauucaggucauggcagguuaucacuuaccucuuuaaagauuuggguaguugagacaagccuccccucuucagcuuacuuauacuguuuuccagcuauucuaucaauuuucaucuaaagaauggagauggagaaaagacacuuuccucucccuaucacuucacuuuguauuuauuuuuugcuauuucucauuuucaggaaugacuuuuuugaugagacuucaggcuuccaucugacuucuaugagacgagcacuagcuugucuuucaugacuuuuucccaaauuauuagcauacuaauuuagagaauuaucccugucuucauuaguuuagaguuugaauuguuuuaaugaaucauaaaauuuaguacuguuuuuuuaauucuuaaaacuugugguacagucuuuuacucauucaguuaaaagacuuuuucucuagucuuauguauaguguaaaacauggaaguaaaacuccaccagaauaacguuuaugaacucaugcaaugucuaacaucuaucuaaucugugucacuguauauaucauaauauuuauuauaucauaacauauauucuuucuucuuucaucuuccaugcugucaugcucuugcaauagaaugaaagcacaaguggaaauuauguaagcucacaccagaaaaauaaagagugcucuuauuuuuguauuguacaguaaguuuccuuguaaaagaaguaagaugacagcacauaauguagcuugauucagugauuugccuucauagguauuacuugaauguuuuaaugauauacuuuucuaccaauggaauaguguugcucaaauacugauugguuuaaaaacagcaguguuuuaguagauaaaaaggagaugaagcaacuuucauggaagaacuuuuucuggauuguguaauuuaugcaugcaugcuucuuugauuaaaaaccuugcuaagaugaacuaccagcucucccuuauaauaaaacuccaaggcaauuuacacuuaaucauacugagucaauucguugaauugcucaagauugcaaaauagaaaacuuaauuuaucauuuguuaucuuuuccagauuuauaucaagcuaugugaauuauuaccaaaguguuaaacuaguuaaguacuuugucagcaguuuaaauaugaaguauuacuaaagcauuaaagacaacacuuuaucaaugguuuaaagauauacauuauaaguacuguguacuauuuauuuaaaguacgaaugcugauuuauuaaaggauuuucuacucuuuccacuuucccuguuaauguuagcuaacaagaagauagacuucuaaauuaccuuuagcuuuguaccuucguuugggaaagagcaaaaaauaaggcauggggaaaauauuuuuauuugugaagucauuacugaaggauauuuuugcguguguauuugguaaaacacuucacuuccuuggagcaguuaaauaagacauauuuuagcaguuugcauuguuacuauuuguuaaaacaaguagugugguucccuucaugccaugaaucuaaugcuaauugagggaaccugaaagguguuuaacauuucuuuuagcuugcuauuuuuuucuuauuguucuugauagauuauugaauagauuuuuuaaaugccacuuguucucuuaaccugaauuuuguuucuuuuaauaaauauguacuuauuuaaauuaaaaauaaaguacagucaugugccacauaacauuuugaucaacaguggacugcguguaugacaguggucucguaagauuauaauggagcauguguagaaaccugauacguggcacuuaauauuggcauaacagaucaguuaggggaaaugacugauguguaguaaugaugcugggacauuguguuuuuucauaugaaaauauauauauaacuuuaaaaauaaacaucgucugggcuuguguaaguacacucggugaucgcagaacaaugaaaucgccuaacuacacaucucuuagaacguauccccaucauuaagcaguacaugacuguauauugaaagaguauuuuauuuugaaacugcucauuauuuuauagauaaccuuaggagauucuaagaacaugcuaacguguaguuacgucauuuuagagagcuugcauuguagcaaguagaugauauuuuggaaguauugcuacuguaaguauaucugagccuacaauucagugauuuaauagaauuguguguguguauguagccaaggcugcugcucucuuggacucagucacguuccucuguaaaauuguuuagguuuuugcaguacuuuuauuugagaaaggagagucuuuuucuaacuugcacaaagauucugcaaaagcaagagguggccuuguaaagaucucgauagugggucuacaauaauguuucucaaaguguuaccuagagucuuuugcagucuguuaggucaucuuuuggaaaguugacaucuucauagaaaaaucaaaaugugaaacaauuuucaguauuuuaaaauuuagauuaaaucuaaauuuuuacaaaaaucucaauaguuuucuguagucauuacauucuucaauauuauguaagugcuacagggacugagcuuugucaguucaucuuggcuaacauuaaacuauuuaaacauuaaguuaaacuaacauuaacauuaaauuaaacuauuuaguauuauuuaugccuaguuaaauucacaguuuuuuuccuguauuggucuuauauucacaguuuacgaaaguagaucaauuuggagcauuuaaagugagagacguaauacagaauuacugcagcuuaaaaucugaauuggauuuugucagacuagugaacucuuugcccuuguguuuaucacgaaauuuuaagaaacuucaaaccuucaaaauaguuguguuuuaugcaaaguacauuguguguuuuuuuuuauuggcaaaccaaucauuuguuucacugugaaauugcuuaauuaugucacauuuguggggaaaaggggcaucaaaacuauacaggcauuauucacaguucuacuuacagcauaaacagguucaagugacacuauugggaauaugcuuaugaauccagcugcaaaguuaauagccaguauaguguuuggggaaacacuauaagcuauuaccaaaaaauccucugugagaggguguuaguuggaugucacauaacauaaaugauguacuguguggaagaacaguuguuguauuguguauugugggauuuguuuuuagaugaaaccguuaauguauguaguaggaauuaacuuuuacauaggugaaguacaaauagagaagugauagugauuuuuuucucuuuaucaccaaaaucuuauauugcuaaagaaugaauuuucccucucagaaaacacuacauuauccuaauuucuuuacuuuuuaaucuugcuauucaacagaaaaauauccuauugcauucuucuuuuccaaguaugucuuaaauaacgguagcccccugcucuuccauuuuaacuuuagagucagcaugucguuugccauuaacgaaaaccaaaacaaaacaaaaacuaaagaaaaccaaacuaagaggauaucuacagaaauuucauugaauguauuaaugccaguuacuccacaaacuggccuauuauuauuuuucccucauuuccaaaccguggcacagacaggcagauuuucuucaugauucccuaugcuagcagguggauuuuuuucccuagcuaccguuuuuuaaggucacugauuucugcugauagcucacuuucagcuucuaccuugcaauagaccaagauguaguuucuuuucucagacuugguauauaauuuccaaaacucuagauuucuagugagagcccuuucagauguguuuuagcuuuugaauuugccucccaucuuuguucaccuccuggauuauuuguuuuuauccugggauuaacuuaugauuggagaaaugauuuuuuagaaguguuaccaugugguuguaauuuaucaaacaauuaguauuuucagaggaagaguuuagauuauauaaauguuuuauacuauggaaaauauaauuccuuuuaaauuuuuaaucuuuuuuucuuauugauucucuuuaacuuuaaauaauauauuugucuuucauuucuuauucgucaacuuuauucaguguuguuguuuacuuucuucucuagucuucugucagguauaccuuuacuuaucuuuugucauaauuaugagcauuuauauucucuucuguaaccauacauauuucuuccauucuuuggcuaucucuaugcuacauuuuaguuuucuucauauuuggaucagauauuccuguauagccuuuuauauuuugugggauuuuuaaugccuuuucuuuuuuguugcuaucauuauuaauaauaaaacugcgccuucacuaugcccuuaaguuuauauaaauauguaguuguguaugggauuauuuauuguuuuaauuuaaauuuuuauuuuaaauuggcaaacaaauacauauugugggggacaaugugauguuuagauacguguauacauuguggaaugauuauauaaagcuaauuaacauauccauuacaucacauacuuauuuuuuauagugagaacauuuaaaaucuauuugcaauuuugaaauaugcaauacaucauuauuaaguauggucaccacacugugcaaaucuugaaaauuuauuccuccuguugaacugaaaguuuguauauccuuuggugagcuucuuccccccacccccugcuuuuuuugagacagaguugcucugucacccaggcuagagugcaguggcaugaucucagcuuacuacaaccucugccuccuggguucaagugauucuugugccucagccuccugaauagcugggauuacaggcacgcaccaccacaccugguuaauuuuuuauauuuuuaguagagaugagauuucgccauguuggccaggcuagucucaaacuccuggccacuagugauccacccaccuuggccuccuaaaaugcugggauuacaggcaugagccacugugccuggccagcaucuccccauuucucaccacugccacccgcuaggcauugauaaucacuuucuacuucuguaaguuugacuuuuuuagauuccauguauaaaugaaauuauguggaaaaaagaaggaagcuccgucacuugaaacaacaugaaggaaucuggagaacauuaugcuaagugaucacucuuuuuuuuuuuuuuuuuuuuuuuuuuuuugagacagaaucucucucugucgcccaggcuggagugcuggaauacaguggcaccaucucagcucacugcaagcucugccucccggguucacgccacucuccugccucagccucacgaguaguugggacuacaggcgcccgccaccaugccuggcuaaauuuuuguauuuuuuaguagagaugggguuucacuguguuagccaggauggucucgaucuccugaccucaugaucugcccaccucgaccuaagcggugggauuacaggugugagcccccacgaccgguugauuacucuuuuuuuuaauggaccucuccuuucuuaucagcucccuuucuucugcuccaaucuagaguaguuguuugcuaggccugcucucuaucuaucuaucugggagauccauuacuauuguccguacucugcuuuuuucuguuuuaugguuuuucccauuguauugcuggagaauuaccuaagaaagauacuguggagguaaaauaucugauuggccaaaaucuggaaauguucuucaucugucuuuaugcuugauugauaguuuugucagguuuuauaaaguugaaguaucgaaauuauuccuuagacuuuugaagccauugauuuguugucuuuuuaguaaccccagucauguugauagaaaagucugauguuaaucugcuucacagucuugcauugguaacuuguuuuauucucuacagaaguuuucagaauuuuaaaaaauauuugguguucccuaauuucacaauuaugugacuuggugugaucauuuauccuguuugccuucaaugggcccuuuuaauuggaagacugcaucuucauuucuaguaaauguucuuccucuauucuugaacaauuuacuuuuggggcuucucuuggucagauauuguacuaagguugauuuuauggaauaagauuguuagcuguucuuugguucugacuuuuuugccugggguacagaauuuaacagaaacaaagucuauguagaguagaacagucaguagaauauuuuuguauggcuuuucuuuugcuccuguauuuuuuacagaguauguauuugcuguggaauguccacaaaagugcacaagugcugcaguugagaacaagggcccauucuugccacaugaauuuccuuuaauauguauguuccagaaaaauuuacagaaacagucuguauacuucaguaaugguacauauguucagugccccugaguuuugaaccaaauugcguaagugaggauauaaccucauuguggggaagcaggugcaccauauccagauauccauaaagaggaucucuuucucagaaggcagaguucagaaggcccaauucuuugaguuugcugucucauucauuuuuuuccuucuauuuucuguccuuuugucauucuuuuuccuuuugcuuuaaguucuaggagauaucaguuuuuugacaccuaagcauaauaggaaaaacaaucauuaucuuuuacuauaugaguccagaccuuuuaaaguuuuugaauguuuaagucauuuuucaaauauuauacagcagugcgaauaaagagguaauaaagucauuaaagauuauaaaaaggauauaaacauagcaaagucauuuuuauuucauaaucccauauuuuccuaguuuuaaagauauacaaacaaaugguucuagcuuauuacugcuuuugguuuuucuucuugcacuugcaucaucaaaauacuuuugaaaacuuugucgacucaaaaauuuuuuuggagagagcagcuguuuuugcuccauaauuacaaagcaguuucuauuuuagauuucugaacaucaauucaaaugauuaaagauugaucuuucauuuugauaucaccuauucuuuccacuaccuuuauuuauacauuugccuacugcauauccacuuccaugccauuuuauguaaauuuugguauguaaauaucauguaagaugaaagaaugccaucacaagucauuuuagcaaaauggaaugguccucagucaugucccagaauaacguauggugaaaucauuuuuguugaaugacuuacuggauaagaauaccauauuuccucucuguuuucagaaauauuuuguauuuucucccuauuuuuagaaacauauuuucaugcaucaauuuuugagcuugagaaacuuuauauaggauaucaucuggagauaaauagccugagauuucacuuaugugaucaauuuuaucaucauuagcuaaagugcugcuguuuugcauuuagcuucugauucaucuaauaaugguuaaaugacuuccuccaucaguguucucacugaccaugggcacaaauuuuaaaauucugaauuuuuaaccauguuuaaauaaagcuaaagaagaaacucaaaagauggugucuccagacuucuuuuaugucuugcaguacaaaaacugaagaaugauauaauagugauuauuuauuucauucuuguaucauccuuuagacaauugccucauuucacauuuuaaaaauuagucuuuuuaaguguacacagaaauaauuaaugcauagugaugaaauaauuacucagauaaugaauaucuauauuucaagauauaggaaaaaagaucccauaauguaugucagauauauaaaaggguacaauagagccauaugguaauugcaaguaagaauguguucucuauuuuggaaaauaaauaaaauuuaucuuuggucuuuggaagaccacuagcaaagaaaaaaugucaugaaguaucaguccuuacuaauaguaagaaauauugacaaaggaaacuuaaaaccuaaaacuggagccaauggguccucaagggaugagaauauaauauauuuuuacucuuucugaaagugcuuauuaaagguuuuucauuuuuaggguuuuuuuuugguuccaaguuauuucacccuucucacaaauucagauuucucuuuuucuacccuccuuucuuucuugucucccuuucccuucccauuccucucucccuuuccucccuucuuucuccccuuuacucucucucuccuuuuuuccucccccucauucccuucucuccuuugucuuccuaaccucauuuucuuucugucuuccuuuuuuuuuuuuugaggcagaucucacgcuaucauccagacuggagugcaguggcaugaucucggcucacugcaaccuccacuucccaggcucaagcgauucuccugccucagccucccaaguagcugggauuacaggagagcaccacuaccacccagcuaauuuuugucauuuuuaguagaggugggguuucaccacguuggccaggcuggucuuuaacugcggaccucaaaugauccacccacucggccucccaaagugcuaggauuacagugucuuccauuuuuauucuaaugucugguaauuuucugcugucuuuuuauauuuaaaaauguagguauaguuuauuuuagguuuuauauaccuuucuccuuugcuuuguauguaaguaguuuguuucucuaauacgcccuccccuugagugggaaacuugauagugacuaauaguacuuguuagggcauauugauugaaauuuucagccuagggugggugggaugagaacuuccaacuaggcuguagguucccuaaugugauggugaggaggaaauuauucuaguuguuaacaccaacaugagaagucuuaccacuucccaguuaaugagugcagcccccuuggaaaagagccuuuguuccuagaauuuugcaaaauggaaagguuguuaaauacaaagaugcugccugaagucauuuucagggaagcggagaauaaggauggguagucauugaaacacuuguucuguguguaaacuucuaauugauccccugauuucagcccuacuuuuuacucucacccuuaaucccaguggcucccaucuucacuguagccaccuuguaguaucuucuggauuuuggccuccucuguuuauuuuaucccuuaaccacuuaccuuccauuuuccugaaauauguugauauuuucuuccacucuccuuuccuucacuguuuugggguuuguuccuuucaaucucuauaccuucauuacuaggggacuaggaaggacagaaagucaaugcauuuucugaaucauguauauaggcagcaucaaauuguaucaaacauucaauggagaacuaacaccaauucuucucagccucuuccaaaaauggaagagaagggaauguuuccaaacucauuucacgaggccagcaucacucugauacugaagacagacaaagacacaauaaaaacugaacaagcaaaaaaacuacaggccaauacagaugcaaaaauccucaacagaauacuagcaaaccaaauucaacagcacauuaaagagacuauucaccaugaucaaguaggauuuauuccagguauucaagggugguuccacauaugcaaaucaaaauguuuguuagcagaauggagcacaaaaauuauaugaucauuuuaauaaaugcagaaaaaguugaaagcuuuuucucuaagaucuguaucaagacagaugcccacucuauucaauguaguacuaugaaccuacuagaagaaaacauaggggaagagcuccaugacauugaucucaccaaagauucuuuggaaaggaccucaaaagcucaggcagugaaagcaagaauagacaaaugggauuguaucaaacuuaaaaaccuucugcacagccaacauuaacagaguaaagaaugagagaaaauauuugcaaacuguaucugauaauggguuaauaucuaaaguauaugaggaacucaacuagaugguuagaaaacaacccaauuuaaacaugggcaaaggaccugaauagacauuucuuuaaaaaugacauacaaauggcagacagguaugcgaaaagauguucaacaucacuaaucauuaaaaccacaacaagauaucacuucacaccuauuaggauagcuguuaucaaaaagaagacuaguaucgagagggugugaagaaaagauaacauuugcacguuguacguggcacagguauuguggaaaacauauaaauguucuuccaaaaauuagaacuaccauaugaucccauaaucucacuacuggguacaguacuuuuccuuuguccaaaggggauaugcuccaagacccccagcagcugcccaaaaccguggaugguacugaacccuguauauacuguuuucuccuaaauauacguaucugugauaaaguuuaagcacuuaucacuuugccuuagcacuuuggggcaauuauuaaguaaaauaagggucacaugaucacaagcacugcgauaccucgacaguugauaugauagcugaaacagcuacuaagugacaaacaggcagggagcguggacaguguggauacccugcaugaagagaugauucacauuguuuauuucuguaauuuuccauuaaauauuuauagaucacaguugacugcaggaaacugaaacuguggaaagugacacuucagauagggaguacuacuauguauaucaaaaguaaauaaucaguauguugaagagauaucugcacucccauguucauugcaggcuuauucacaauaggcauagaauaaaccuaagcauccauuaauggaugaauaaagaaaauguggucuguauacacaguggaauacuauuuagacauacaaaggaaauucugucauuuacaacaacauggaugaaccuggaggacauucuuaaguaaaauaagccaggcacagaaucuuaaaaaauugaucuuauagaaguagagaguagaaugguuguugccaggggucugugugguuaugggaagguuuuggggagauguuggucaacugauacaauauuucaguuaggaagaauaaguucagggguucuauuguauaacauagugacuauagugaaaaauauguugcauucuugaaaaaugcuaagaaaauggauguuaaguguucucgcugcaaaaauaacugugagguaauguguguauuuucauuagcuagauuugaugauuucacaauguauguguacuucagaaccauguauagcacaccauaaauacauacaaucuuuuauauguuaauuacaaaaaaaaaaaaaaaauuuuaaggcaggaucuauuacaguuuuuacuaccaccaguguuugaaguuaucguuuuauagcaacccaaauauuaaauuuuucuaccaguuuaaauuuuaaaaauaccucucuuuuguuauaauguauaauuuuuuauaggugacuagcaagaauuaccauuuucucuuuugaguuuuuguuaugacauaguuuucuauguauuguuuauucauuuguacgacauauuuacuguaucauccugauuuuuaugacaguuuucauaaauucuuuaugcaguauggaugcaacucuucauaucugcuguaaauaucuuagccuuuguuuucauucuaaauuuaguuauguuuauuuuauaaauugcauuuuucuuauuugacuacauuuauguuucaugauuuguaaaccuugaagcaauagaaaagguuauuuucucuccagacaauuuacacugaaugagauuuuuauuuuuguuuuacuaaacuuucuaaaauuaguauuuauagaacacuucugcaaaauaauuuugcaguguguauugaaagccaagaaaaugucucuguuuuaauccucuuagaagacuuaauuaaaaggaagaauaagguuugguguuuugaaguaagcauauucuuauuuuaucaaaugcuuuaaaauauugaaagucagguaaaauauuuuuguguuuuccagauuauugcucaguuguaacuauuguggaccagacaaauguaaaacuaacuugccugcucuuuaguggaaacuaugaagcccuuccaauaauuuauaaaaauggagauauuguucgcuuucacaggcugaagguauaauucauauugucuagaacuuauauuuauuugaagagaacucuguauuguucacugaaacuaguuagcacuaauuauauaguugcuuuguuagaacaugacagcaagcuuuucaggagauaagaaguaauguaaauauuaucagacuucaaauaauuuacaguaagaaacaucuucauuugaacaaaccacugcuuucauuccccagaaauguauuacaugccaugauuaaaacugguuccauucugucuucuguuucuaaauacagacuaaugcuauagaaguuuuaucuguagauuuugauaaagaacauuuauuuuuuaauguuuuaaaaaagagcuuuaggucaacaagaaaaaauguauacaaagauuaggagauuauauuauucuuucccauuucuuguguuaauucaaguucaaugaaaacauugagauacuaaguauaaaaucaaauuaaguugguuuucauuuauaagaaauaagauaugaacaggaacuuuaaaaauuaugccuguaguuaaauaacuaaauguaagaaagccuuuaauauaggguagaguuauuaaauagcacaauuaaaaaaauuuuagaacuuacaaauacaaaggauuauuauuuucucaaaauuauuaucuuuauugcuauaauauuuauuuaauugagcuuuuuuguucaaugcacuucuggaauuuuucuuuggaaauuacuacaugaugcuuuggacagcuuuuaaauauuuuguauauauucagucccuuagauuuuaaauauuucuguuucuucaucuuuuccucuguuacauggguuuccauguaaccucuucaucaucuugguugucuuuuucuucuaaugcuugaguuuaauucuguccuucauggucagucugcugcucauaaacgaggacaguguucagcuguguucuacucuuaggcacuuuuuaugaccuauuaaugcuguuuccuugagaauaagaggauaauagagaauguuuguguaaagauaaaaagaaauagaaauauuaucauagccaggcaugguagcucacaccuguaaucccagcacuuugggagguugaugcuggcggaucaccugaggucaggaguucaagaccagccugaccaacauggagaaacccugucucuacuaaaaauacaaaaucagccgggcguggugguaaugcuuguaaucccagcuauucaggaggcugaggcaggagaaucgcuugaacccggagggcggagguuguggugagccaagauugugcuacugcacuccagucugggcaacaagagaaaacucugacucaaaaauaaauaaauaaauaaaaagaaauauuaucaucauagaaauguaauacauacuuauuuaaacgucaaaaaauugcuuacuuuucacaguauuguuuccuguauacuguauucaaacaauacacucuucauaaacauauuuaguuguuguuauuguuuauggaaguuacuauuuaauagcaaauagauaaacaucucaucauucacaauauaaccauacucacauagcuaacacucuggaaacuuccuucauaacccccuccaguaaggucauuauugugucuccugcuacaggaguaaagagucucaugaccucuaacagcauauaguuaccccuucaacaacacagguuugaacuacauggguacacuuauaugcagacuuuuuucaauaaguauuuuggaaaauuuuuuggagauuuucaacaauuuguauacacaaacacuaacagaccaugcauggcuccauucacagucuagagaaaugugaaugaauguaaagaugcgguauuaucacuguauaaaauuaacuguacuacuauaauaauucagccacuucuuuuguaauauauucauuuaugacuauaaauuuuuuaaguacugcccuaguuguauccagcaguuuuuaauuugucauaacuucauuaccauucaguucaauauauaauugaauuuuuacauugaucauagauuucaucucugaucuguaaguuuauaaauaauucuuaaauaauccauaagucagagaggaaaucaauaugaaaauucaaaaaaauugaauuaucauugaauauauauugaauuauuauugaauauaauauauugaauuauauugaacauauauuuauauauugaauuauauuugaauuauauucaaauaauccaaauaauauauauauugaauuauauucaauccaauuccuuaggauuauuacuuuuuuauauuuauuuaaaucauuuaauaguuaccuuuuuuuacuauuguuuauugugguggucagaaaacauacucugaaauguuuaguauuuugaaaucuguggaugcuuacuuuauauucuaacauauggucaauauaauuuuuuauuucuuaucuauuuuaucagcuauugaaaacuguuuuaaaggcuacuaugauagaggauuugccuguuuccuuuagcucuaucgauuuugcuuaauaauuuaaggcaauguuaaugggguuuaagccuucuuauuuaauuuuauguuuuauauauugugaggcuccuguauagauuuagcauuacuauauuuuucuauaaaguuguuucucuauuuucaugaaauguucauauuuacggcuaguagugcuuccuuacacucuuuauguugacaguuccacuagcuuugaaucgcccuguugucuuugguugagcaaggucauucuaaguacagacauuuguuuuagauaucagaauuuauuuuuucuuguuuuucuuauugcaauuugaagaucauaguucauagcaaaaauauacauuaaaacaagagucaagaucuacucuucuuuuuccagcaaauauuuauuuauuuauuuauuguauaggcaucuguuuuaaugcaaagaagcagacaguaugaaaguaagcauauaaaucaaaguaauuucaaguagugauagcuacuauaaagaaaauaaagugguggcucacgccuauaaucccagcacuuugggagggcuaggugggaagauugcaaggucaggaguucaagaccagccuggccaguauggugaaaccccgucucuacuaaaaauacaaauauuagcuaggugugguggugggugcuuguagucacagcuuacucaagaggcugaagcaggagaauugcuugaacccgggaggcagagguugcagugagccgagaucgcaccacugcacuccagccugggugacagagcacgacuccauccaaaaaaaauaauaaauaaauaaauaaauaaaaauaauaaagcaaaaucaggaaaggccuuucuaaugaggagacauaagaauugagacccaaaugaugauaaugagaaguccugcugagauuugagggaaaauguuuuccaccagaugacacuauaggugccaaggcccugugauaggaaugagcaugguauuggagaaacagaaauaagaccagcaugggcagccaugggggagguguugcaagaugaaauugugguagguaaguuauuuagauuuuacucuagguauaaugagaagucauuagaggguuuuaaaugugaacaugaaauuauugguucaaauuuugaaaaaaaucucucuuacuaacguggauaacagauggguuguugaagaacaagcaugaaggcaaagauauucuuuagaaggcuauuucaguuuuacagacaugaaaugaggaugcguuagacuacaguggugguggaaauagaaguagacuaauuaagguauauuuugaaucucaagcaaagaggaccugcucauaaaugauaugugaaagcuaccaacacaccuaagcuggaagauuguucugguuuacuauguuaaucagcagaggcaagcuuuagucaacaguauacacuagugagcauggaauuggugauaaaaaugaugaccacagaaccaagaaucaaucagacauuggaguauaaaagagaagcagcauauacaucaaguagaacccauuuaaaaguuagguaaucgaucaguuguaggcaaguauaguuagaaucugcagagcgaacuucuguguuacgaaaaauuaacugguacuagacuagcccuacuaccacgaagacccauaaaacguuaugaggcaacuguuuuuuaggcaucggacaauggguagcuaugaucagagagugaagagaaacuuauaaagugagccccaugaugaccacaucccugccuauagacauuuucucaaccacugcacaguaagcugaaguucaagcugugguccugcuauagcuaaagucaaaguucaaggcagcugaaagcuggaauuuucacaacaagaaaccagagaggaaggaguuauacagaaggggaugucuaaaaguccaccaggguuggggugggcucgaauacuugguugaaagccaggcugcacagagcaggguagaacuacuuaaggauuacaaaagcugcugugugguugaacugugguugaacaugaaauggauacuggaggucuaguaauggggugcuggaaguccaagauagucagggacaaauaaccuuauuaauaccuccuuaacagcuuggacauucagcugaggcagcacaaagguuucaccccccaaaaguagcucaccucacgaaggaccacaucuuauaguaaggccuauucuacacauguuuuaucaaagccugaaacaaguucuacggagaagacuucgcagagaguuugcagggugagucccaucaagguagaagacuuugggaaacaucaugggcuuuccacguaucacccuaacaaagcauaaaaacaagcauucaugaguuuaagaugaccagacaacaacucaguggccaacaagaacaaaaaucaguguuugucagaagaagccaacauaauucagagucuuuacaguauagcaucuaugaugucuaguaaagaaaaaaagauauauucuacaugaaaacaacaaaguguuacccuuagucaagaaaaaagaaaaaaucauacacauuccaaaccaacuccaugguagcccaaauguugucuuuauuaaacaaaaacuuuaaagcacagauuauauagacuuucaaagaauuaaguggaggugagaagaucccuugagcccgggaggucaaggcugcagugaaauauuauuacaccacugcauuccagccugagugacagaacgagauccgucucaaaauaauaauaauaauaauaauuaauaaauaaaauaacuuaaaaaaggaauuaagugaaaauagauucagugaauuagaggaagauguuaaaugaaugaaaagaaauuucaucagagaaguggaaacuauuaaaaaaauagaaauucaggaacugaaaagaacaaaugaaaaaucuaauggaugggcuaaauagaucagauauaaguuaaauugaugacaaaucauuagaagcuaccuaaucugaagaacaaggauuaaauacaaauuaauagacccuaaggaccuauggaacaauaucaaggguuacauguaauuuaggaugcaagaggagagagggugaagggaaauaaaauauuuauagaaauaaggaccagaauuuccccaaauuugaugaaaaacaaagacuuaaauguacuuuaugcaggguaugugcaaagaaacgcacauccagacaaaacuuucucaaugugaaaccauugagaaagagaaaaaucuugaaaucaacuggagaaaaaaaugaugcauuguuggagaacaaugauaccagucaucuuucacuucuuaccagagacagugacacccagagaacaaagaaguaaguuuuauauggugauagaaaaaaauuuauucacacagaauuuuauauccagcaaauacauucuucaggaaugagaguaaaauaaaaacauuuuauauaaaggaaaaaugagauaguccauggcagcauaucugcauagcauuaaugcuaaagaaugauauucaggccaaagaggaaugcuagcaacuagaagcuggauaguuaagaagugacaaaaauacaagaaaugauggaaaaaaauagcaaauacguaaacacaauguuuuucuuuccguaauuuaauuaaaagagaaaugucuauuuaaagcaaaaccaauaauauuacaugguggagauuauaaaauauguagaaaaaauacuacaacaguaacacaaaggauggaugggauaaguaaauggaauucuaccauugaaaagauauuugugaaguagaacgcguaaaauaggaaguggcaaguaugaaauggaaaguagaaaguacauaguggaacaauauugauuccaaguggacauuaagaaguuaaagauuuauucauagcuaagaagaacgaaauggagcacuaguaagaauuccaaaaagaaaacaagaaaggaacaauaggaaaaaaaaugguuuuaaaaaagcaaagaagcaaaaaagcaagaaguaugaaaaaaaggaaaacaaauaagauaguagacucaaauauggccauguuaauaacugcauuucugugaauggacuaauuuccaauugcaaggaaaagauugacugaacaaaaauaaucaggaaccaaauauaugcuaccuaugagaaaugcacuuuaaauaugaagaccuaaacaaguuagaacuaaaacuguaggaaaaaaaaugugcaaaguaaacauaagggaaaugaaguaacgauauuacuacgagagaguuuuggaaggagcauuucauaaggacaaaggggucacuucaugaagauguaacaauauaaauguaugugccucugauaacagcccccaaauucagaaagcaaaagagcuuauggcauaucucagugcucucagucacucugauuaaacucuagccugagcuucauuuuguucacuuuauauucucauauuucaaguguucuggucuuuucuauaauauucauaagucacugucauuuaugguccuuuuuccuuguauaaauuacaccuuaauaaaaaaacuaauaaauguaaaacugcaagcuugauaggauuagggagacuaccaccuagcucuuuaaaaaauguaagugaauuuugcauggagguucacaguuuccaugauacuucuguaucuugguguagcaccagcacuugaguguagaauuuacaugcuaauuaaaugaaaaauaguuuuuaaaaaaugcccucucuuaauuaugcuggcaaaauugauaaucuuuccaguuucuuugguucguagguugugcaucaguaagcuauuuuauuuguaucuguuuucuacuuugcccuacuuucuuagauucaaguauauaaaaaggagacucaggguaucaccagcucuggcuuugcaucuuugacguuugagggaacuuugggagccccuaucauaccucgcacuucaagcaaguauuuuaacuucacuacugaggaccacaaaaugguagaagccuuacguguuugggcaucuacucauaugucaccgucuuggacauuacuaaaauugugugauguucagccaaugcaguauuuugaccugacuugucagcucuugggcaaagcagaaguggacggagcaucauuucuucuaaagguacauauuuuuuaauacugggaauuauaaguuagcaccacuuacaugucuguaaagagcuuauguuucagcauucugaugagauaaagcaugcuguguauuauacuaggaacuuaaauuuuaacuauuuuugacgagccucaauauucaugcagcucuacucuuguaccucucuaaaauuuuacacuuuccuuccagagaaauauaguguuauuagaucuacauguuaaauauaguaugacugaugcauuuuuaaaauuuuaguaguaauaagauguagacuuguuuucuauuauuucauaguuuguaguccuauacaugaauauuucuguuucccugucaaggucaccuucccucucauuuauuuacuuuuuugucccguugauguuggguucucuucuuaugucuuucacugccuacuucauagucauaccauggacaguuuugaagcauuuugcauuacuguguuuugcuuuuaaaucagcaagauaaaaaaauaacuuaagacccaucaaaucucuguauauaccuaucccaguuuagagaguaacuucuggagaagcuggauguuugauguuuuucuugccuggacauccuauggaggauacauuugaacaaaugccucuucaggccugcuccuaugguuauuucucucuauacuaucuuuggaauaauagggcaagaaauggaaugcaguggcacuuggacaagucauggaguuuagcauuauuaugauuuacaccuugcccauauuaaaaaacagagaaguuagaaaucauugaauaaaauacaaaguucuagcaguugaaaauagcacacucauauacacauggaauauuaugagaaagucguaaauacaugcccugcagaaaguuaaauaagucaaauaugauaaagcugaagcuaaagcaauauaaaaucaaacaaacuuagagcgaaucuaggucaaccagucauacucuggcaaaagugacauucuuaacaaaugagcauuugcuaacaacugaacacuuccuaugacaaggacucuacuacuaugcacugaggcauauucuaucuuuugacuguguuuuuagaaaauucuuaaauucuaagauaaaaugugccaacuuuuagcugaaauaguugagucuacauuuucucucugcagaaacacagcacauaccugcaucccauuguaacagauaacuuuuuuggacaagugaaaaccacugucacguaacuguuaguuuaaaauacaauauugaaaagucaaaaaagagcccauauagccaagacaauccuaagcaaaaagaacaaagcuagaggcaucaugcuaccugacuucaaccuguacuacaaggcuacaguaaccaaaaaagcauuguacugcuaccaaagcagauauauggaccaguggaacggaacagaggccucagaaauaacgccacacaucuacaaucaucugaucuuugacaaaccugacaaaaacaagcaauggggaaaggauucccuauuuaauaagugguguugggaagacuggcuagccauaugcaguaaacugaaaguagaccccuuccuuacaccuuauacaaaaauuaauucaagauagauuaaagacuuaaacauaagcccuaaaaccauaaaaacccuagaagaaaaccuaggcaauaccauucaggacauaggcaugggcaaagacuuuaugacuaaaacaauaaaagcaauggcaacaaaagccaaaauugacaaaagccaaaauugacaaaguuaaagagcuucugcacagcaagagaaacuaucaucagagugaacaggccaaccuacagaaugggagaaaauuuuugcaaucuguccaucugacaaagggcuaauauccagaaucuacaagaaacuuaaacuaauuuacaagaaaaaacaaccccauuaaaaugugggcaaaggauaugaacagacacuucucaaaagaagacauuuauguggcuaacagacauaugaaaagaaguucauaaucacuggucauuacagaaauguaaaucaaaaccacaaugagauaccaucucacgccaguuagaauggcaaucguuaaaaagucaggaaacaacaugcuggagaggauguggagaaaaaggagcgcuuuuacacuguuggugggaguguaaauuaguucagccauuguggaagacaguguggcgauuccugaaggaucuaaaaccagaaauacuguuuaacacugcaaucccauuacuggguauauacccaaaggauuauaaaucauucuccuauaaagacacaugcacacguauguuuauuguggcacuauucacauuagcaaagacugggaaccaacccaaaugcccacgaaugguagacuggauuaagaaaauguggcacauauacacccuggaauacuaugcagccaaagaaaggauaaguucauauccuuugcaaggacauggacgaagcuagaaaccaucauucucagccaacuaacacaagaacggaaaaccaaacaccgcauguucucacucauaagugggaguugaacaaugagaacacauggagacagggaggggaacaucacacaauggggccuguugugggguagggggcugggggagagauagcguuaggagaaauaccuaacguagaugacggguugauggguacagcaaaccacuauggcacguguauaccuauguaacaaaccugcacauucugcacauguaucccaaaacuucaagcaaaauuuaaagaaaagaauuaguaaaagccuuucuuacaacaauuuaagaauaagccucaaaagucuuuuuguacccuucaacucagcaauuuuauuuucauuaucuuaaggaaauaauuuaaaauauuuacaaaggugcauuuaaaagaauauauuuaucuuucuuacaguauaaaaaaugagaauacaguagaaaaauuagaaaaaaacaaauacuaacaauagagaauuguguacacuauuuauguaggaugaccauaaaauaacauuguaaaugucaccauaaaauacuuuguaaccauaaaaugacauuauagacauacacuuguugagauagaauuucaugauggucuauuuagugauuacuguaguuucauuuacacacuaaaaauguauauguacauagcaaaaauauauugggaggccuauaaagcaacauuuuacuguuuucaacucugggaaauaugagugauuuuuuuuuuccggacagugauuuucuuauguaucagaaauaauuuuuaaauuauauuuuuuaauaacagaggagcuagacauuacucgauauaaugucugguuacauacaaaauaguauaaucauuuuccaucucaaccugggcacaauauuaauauugguaccuuuuuuacuaaccacagugcauuuauuuuaauuuuucaguagccgugguauaccaaucguuugcauuaaauauaauuuaauaaauuuguugaucugacaucauuccauauuuuucucuauucuguuaauauuauauguuuuuuuuuucugagcaauacucucaaauugaguuuucucuaaauguauauauucuauuuguuuuaauaucuacaguauuggugcggccuuaucuuuuguguguuuuguuuuaugguuuuuuuuuuuuauauaaauaaccaggcgucauuuauagccagagcugguggguaauuuguaugucucaccuguaauacgguuuggagaagaaaaagcauaaugugaaccagaaaaucaucauauaaaggaaauuauucaaauuuacaacauuuacuucuuuguauggaaacaucagaauaaugcuuuacaacuaauuuaagaaugagacugaaucucauaaaaauaauuugauuaaugucaaauguauuacuauuauaauuuuuagagcauucauaauuuuacuaguuguauuuaugugcaaaaauauuuuaauacauaugaguguuuuucaagaucauuuugguuuguuuuuauuguauaaagcacuugacucaggaauauuuagucugagcuuauggcagugugacucuuuuucuccuuuacauucuucuacauuuuccacauuacccauauuucauauguaguucuuuaacaaucagaaaauaaugucauauuuaaaauagugccaauauucagaggcauaaguuuaauuacuuuuaaauacuguuuccaggaaaaaacuuuuuagcacaagcauuuuuucaaaaggaucauaaaacuacucuacucucuuauggcagguaugggauggcaccaggacaccauuuccaucuuggagagucuuaauacaagaccuuguucuugaaggugauuuaagucacauccaucggcuacaaaaucugacaauagacauuuuagucuacgauaaccauguucauguggcaagaucucugaaggugauguauaguaggaaaaaauguuauuuuauguuuuuauaaauuauagugauuuuugcucauguaaauuuuuuauauaugguuacauguauaggugauacagucuagaaauuauauuuauuucuuugauuuuuaaguuguaaaauguauguuacaauaaauuauuaaaagauaaacuuaauggguuagagcaauuuuuaaaauaaucuuucuuaaaugucuuaaagguauacauaauuuuacugugaaaauaguauagaaaaauuuuguugugugagauaauacugcuuuagaaugaaaaaggcuauauaaaauauugcuaacuuaaaugcuaagcuugguaaacugguuugauagaauguagcugauaacuuuuuguucauuaguuuaacaaauuguuaaauuacaauuuguuauaauuguaauauuuauauuacaaguuuauauuauaaguuuauaauauuauaaauuggguguguguauacuguguaauuuauagaauuugcauacugucuucugaaauacauuaaggugcacaguuuagauauggcaguacuuaacuauuaacaaaaauuguagggaauuucuuuucucuauuauaucuuuuauuugaaaguacuuuuuguaguaaagaaugguaugauaaauaauaaugcaguaaauaauaagaguaacuuuugcuaggcacuuuauaugcauuugguacucuccuauaagacaggugaugguagucaucucguucuacaaaugugaaaugaggcacucagguuaaaucagugguucaagauuccacagcuaguuggauugaagcaggguauuucccugaccccuucacgggcaggaacuggagugcacaggugcuggaacuaggcagccgcuucagugcuggcaggggagagcuccacucacucagaccacaggagugggagcaugcaggugagcaggugcaggagccagggcaaaggcuuuugggcacgggcagaagcaaacucuguacuggccccacagcagcaucugagagggugcuggugaccccugaagccccagaggaaguguuacaguacuguuuuagcucugucauccauggacagcuuaaguguuaacagcuuagugcaggguagcugugacugacucacaccacacuuguggcacccgagcucuuguguagcauccaggaggaaugaggucucaagaauaaaaugaagaugguaaauucaggggauuucauuacugaugaaaguggcucagugggaaggggaagugaaaagaggauggagcaggaagguagucuuaccuugaagucuggcccucucuggccagauucuucucccagguuacaccaucaagcugucccucugaagucaagcugcuucucucugacauccagccauagugucugauggccagcugccucucuucccucugccggcugagccugggguuuuuaugggcacaggaugucagguggggugggccauggaugguuuuagaaaaggcaacauuugagcaggaaaacagggauguaaguucucacuuugggccgugguaucaggcuuuucagcuugagagcaggguccuugcuggggaccugcccucuucugcguagaauuucccugccuccugucccuaucuggaugaagccaguguuugaauccacaaugucucuuugcagagcuaaucuuuuaaagcauuaaauggaagugaucuccaucacaaauaucuucuagccuacuuauaggaaauuaaaagaaaacaguaagagugaagaucugaauuucaaugcccaauuucccuuuauaaaucaguggccauggaguagcaaauauauccauucuacauuguaucacaaauaaguucaccaucaauacuguucuggguuacagaaaaaauaguaauuagaaaacaaaacaacaacaaaccaaguaaguuuacucaacucaaaucaauaaauuagauuaaauccaggguccaggaagauagugacuguacuuuuuuguccucuguguguauauauguaugcacauacaucugugacauaucagaaaacacugacuguugaagauauauuuuugacauuauuucccugaaagauauuaucuacauugauuaguuuauuucaaaauuaaauauaugauaaguucaguucuggagguuuuuucauagaguucuuucauaaauaaaaugaauuuacauuuuagauucaccucaguuccacacucugcauaccuuccuucgccauuuuauucccuucucuuucccuauacugcuuccaaacaggucuuccaauguaggucuuucuguuuccgcuuuuccugcuuuucuugucuuaguccugaacagcaccuaucgcagugcuuucccuguagugaggaugaaguaaguaauagcugcugcugaaugaaugaaucagugaaugcuguggauuuuuuuuccagauucuuuucuccuuuuuuauguucugcuuuauuuugcccacuagagggugauaugagcacacauaauuaagaaaauguauggcacuguguuuucugugaagauaucaauagcauuauauuauuugucugcaaugcaauaugaaaaugauuuuucucuguguaaguaauauaacuuuagauuuuuauuuaauacacauugacaucacauuuauuuguuuucugacaaccucuguaacauuucuucuuaauuuaggaacucuucacucacgugacauugauauaaaugaauucuucuugguacuuucaagacaacuguuuaaaauuacguuuuugugucaaaauaccuggaaccaguacgaaagacuuuuguuguauagaaacaggaaaaaauguguuuuuauuuuaguaaagaggacaguauaaugcaauuauagaauauaauauaaucaacaucuacaagcaauguauuuuagagcccgaauugcccuuaacuauuuucugaaucucacuuuuuguuauaucauucccuuaaacauuuuacacagacccagucacauaaacugagauuucaaaucuuuugucuggaaacuaaagcuuuacuuucuaaaucccuacucuuauccagacacaauuguuaauuauaaaauauacguggucauaauuauguuuuggccuucaauaguucaacagcugugauuugguuggcuauuuugagacauauucagggaauuaaaaauaauaaaccuaaagggaaauucuugaccguuuaugacaaaucguuugauuauuucuaaagggauagucauuucuuacuagccauauuuacuuugcuuuuuuuuuuaguguuucuaguuuuuuuuuaguauuuaaauagacuucuauaguuguuuuuuaaacuguauuuuuauaauuuuuugguugauguuucauuuguauuuuuggaaucuuaauacugacaagauuaaccaauacuuguuuuuuuauaauagagcaucuggcacauuucauaguauuuuuagucaagcuuuugaaaaaauacaaugcugccuccauaaggaauuuuugauaauaacaacuuaucuuuaugugaauaacuuauaucuuggccucgaaauuuuguuauguuaaaaaauacuguaguagacaagauaguauaauaaacacccguguguucaccuuauuuuuuaaauguuuugccacauuuauuucagacacuuuuaaauuuuaggaaauaaaacucuacacaucgaaccuucuuugagcuccugccugcucugguuuuuuuuuuuuuuuuuuuuuuuuugcucuccucucugugucuccauauguagguuuguacguauaccuauguuuauuauccuuuuucuuuauguauuuuuugauaggguaaagccccccucucauauucuuuaaaauugauuugacuguucucuuucguauaaguuuuuggauuagcuuuucagauuccaugaaagcuucugggaauuuugauugaauugcauaaaauuuaaaguuuaauuuggaggaaauuaucauuuuuguaauaucaaagccuuuuguaugugaauaucuuucuccauguguuuaggccuucuuucaaaucuuuuguagaucauacauacaugugcuauacuaauauauuuauauauacauauacacacacauauuuuaaaagaaucacaaaauaauccagucaaaaagaaugagauaaaacuagaaaauuuuauguuuuuuccaaugucucacuuugaagacuaugaggaaaauuauuuuuuucuuuuuucuuuuuguucuuuucuucuuuaacuuucuuuauacuacucccugguuaugauauagauguaagugaaagaggucaaaggaaaggcuuguauuuugucugcuccuuauaaaacccuugauugguugggaaaaaagauccuugggaaugaaggaguagcaccugggaguguggguuuucuccuuaccuccuuugcuuauauccuccaucagaaauaaagaguaaugaggggaaauauaauuaagagaagcuacaauaagcagaauuggaaaguugauuugcuacucaucuuuuuuuuuuaaacguuuccuuuuauaggauugagccuccauaaucuaaaaguccagaauucuccuaaaugcagaucuuuuugagugccaguaugcgagugaacccuuugcuuuccaauuauucaguguacaaaaauuuugugucaugcacaaaauuauugaaaauauuauagaaaauuacuuucaggugauguguauaacauauaugugaaacauaaaugaauuucguuuuuagacuugggucucaucucuaagauagcucauuauauauaugcagauauuccaaaaucuguaaauaucugaaaucugaaacacuucuguuuucaaguauuucagauaaagaauauuuaaccuauauaguuuuuuuguuauguaagaugucuguuauucaauccugaacuuguaggggaaaaaaagugguaucccuauagucauccaguagucaggagugcuauauuuauacaaaugaauuaaauuuccuuguuuguaacuccuuuugcuucuaaaucuuucuucauaaauauaaaugugauuuagguuauauagcuucuuuuagguaggugucaauaucuuugaauagcauucugcaucucucucauuugaaaucuccauuaaaagaaaaaucucaguggucuauaauuaaagacauuuguagacuaaguuuagcaaaacaucugagauuaacuauagaacauuuaauucaaaacucuaauuaguuaacucuuacguuugaacucaaggaguguuucacacuguggugguacaggcacaaaugcagaaguuuucuuuccauagaacuuguaagauggaagauguuuauuauuuuucgguaguaccauauuuaaaauuucuucuuagcauucuuguaaugacaguaucuucaggaucauauuuaauuaauccuuaaacuaguuaaagcaaggcauuuucagaaaccuuagucaaauagagggcuugaauuccguuuagguaauggguuucuuaaccauuauauuuuauugaugcuaagacacaauauuuuuucacauuuuaauagaucugaaauggaaauaucucuuacaguugaauguguguguauauguaugugugugcacacacgcauaugcaugcacauguccauauauuuaguuuugauguaguguccaugcagcugauauucaaccacacucguauagcauacuuugcagauacuuuaguauauuuccugacuggucagugcccucauuggccccauauugguuauuaaaguuuuaaauaucagaaguauuuuaauuuuuccccacuuucuaaauaacaaaugaucuauuuuuuagguuggaagcuuucuuagaaucuauagccuucauaccaaacuucaaucaaugaauucagagaaucagacaauguuaaguuuagaguuucaucuucauggagguaccaguuacggucggggaaucagggucuugccagaaaguaacucugauguggaucaacugaaaaaguaagcuuuuaguauuuagaaaauguaaauaagguaucgauuaagccgauuucuaagauaauauuguuccuggggcuucugauaguucccuagccuuuugugccauuugccauguuuuuaaauagaugagccaaaugaaacaaaucaaaugauuauaggcucauagagcuaaguaguagcagagccaggguuauaguugaaguuuuccaacaguuugaaucuggcuuuuacacucaugcuucucuucuaucauuuaccacacucuccaaguacagcaacaaacaggggaaacuagaccuuagcuaaaguuuggaaaauuugauacauaucuaagauuccaaaaauauuuaauucucucaugaaaaaaauguauuucugaagugccacugauuaaauagauaacacauguuuugguguaucacucucuuuuaaacuuuuuaaaauuuuuacaugugccagaaaguaaauaguaucuuagaccugcuauauauuuagaucugcuuuucccaagguauuccuagugaguauugugugcagaagcauuuuggucaauauucuagaaauuuaaaaaaucuucauaucuucaaagagaaaacauacuguucauuaaauuuaaauaacuuuugucuacauuuuaauucauuggaauuagugugacauuaaauuagcuucuguuuuauuacuuuuauaucaauuucacugauuuuuaauaucauauuuagcuucuugaaucuagaguuagauuguucugacucagaaugcuauccauuaaauucccaguuuauuuuuguuuguauuauuucaucauucugcuguuucacuuguaucuuucuaaacucagauuuuuaauuugaacccccggaaaaucugaugaaagcaauagauccuuuacugaagaaugcauauacauacaaaauuuuauauacaauuucaaugaauuucuggauuuuguggguagagcuaaauuuacuauauugacuuuguuuuaugcaauuugaaauuguauucuuucaauuauagggauuuagaaucugcaaauuugacagccaaucagcauucagauguuaucugucaaucagaaccugacgacagcuuuccaaguaaggauaaucuuuaacauugacaguuuaguucuugcuaaauaaaauaguuuuaucaacauaauucuuuguaaugucuucucuuugucucucuuauuaauaauuucauguaguagaggaacauacuaaaaucuuuaucuguggccuaugccaaaaaguaaacaugguuucuuccuaaauuauauaauuacguuuucaaauugggugguagugauuacuugauuaugauauauacauaucauauguguguauucacaagaaaaucuguauugauuucauagacuauuuugcuugucaguuuuuaaagggaacaaagauuguuuuugccacuuauuucgcauaacccaaauacuuuuugcucauaguuauguuagauguauacauaguuacuagucuuuauugaauuaaucagguaucuaaauacaaaauauuaacaaacagagggauauguccuucuaauauugucugcuugaauaagugacuagucaaaucugaacuugaaagcuuucagugugcauuguuuuuuccuuuaccacuuugucuuaauuucuggguuuuuguuuguuuaagagacagugucuugcucuggcgaccaggcuggaaugcagugauaggaccauagcucacugcggcuucaaacuccugggcucaagugauauccucccuccucagccuccugaguagcaaggacuuguaguccugcacaugccaacaugccuggcuuuuuuuacucuuaauuuuuuaauuuuuuauuuuuugguagaaacaggaucucacuauauguugcccagacuggucucgaccuccuggucucccggucucaagcaauccuccugccuuagccucccaaaauucugggauuacaggcuugagccaccacaccuggccugucuuaauuucuacuucugcauuuugggaccuagaaucuaggucauguuucucuguuguuguuguuuuuuuuuuuuucuaccuaacuccuacccugcuaugauccaaagaaucauuuuaugagauguauucucuuuccaucucaauaauaagcaugaaaauuaacacacauuucuugguaggcauguaagugccugcaggcauuauuauuuaauucuuuuguuuguuuguuuguuuguuuuguuuuuuuuugagacagagucuugcucugucucccaggcuggaguguggcuagcgcgaucucugcucacugcaagcuccgccucccggguucagggcauucuccugccucagccucccaauagcugggacuacaggcacccgccaccacacccggcuaauuuuuuuauauauauuuuuaguagagacgggguuucacuguguuagccaguauggucucgaucuccugaccucaugauccgcccgccucgggcucccaaagugcugggauuacaggcacaggccauugcgcccguccgcauuauuauuuaauucuaacaacacuccugugagaugaauuauucugucuccuuuaaacaaugggaaacugaggcuuugauggauggauaucauauaauuuguccauaguuacuuagcuguuaacugaugacaaagcaagacagauucaagugcaggcuuuuugaguuuuuguacauacuuuacauuuauuuucuucauucucucuguuuuaaaacucuccuuauuuuaaaaugcuaacaacuucgugauaacguuuuggccugguguaugauuacuugaacuacuauuaggaaaccaauuuaguucagaugacaaaucacuuggagacaguauaauuuguaauuauacuuuauacuuuuuaaaucucuuuuuccuuuuaaaaugauucauuauuuuuaaaguacacuguaauaugugucauaauauccaguugaauagcuuucacuauaccuuuauucccuacucccugagguaagauuuaacaguuuagugugauuccuucaaucacuucaucuuuauacaaacauauauaccuauauauaaacaauaugacucuucucuuucucuuaaauuuuuaccaaaaugaaaucacacuauaauaaauaguugcuuucuucaacaauauauuauagaucuuuuuuucugggcuaauucauaugacucaaauucauuauaguugcauaauaauaauguuaugcuuuuuucauuuuucauuuaauagauguugagaucguuaccaguuuuuugcucuuacaaauaauacuuuaauaaacauccuugaauauauguacuuccauguuuuuacuucuccacaauaaacuaaaagugaggucgauguaucuaagguuaugcacauuuuuuaauagaugcugccagauuauuuaccaaaggucauagaaauuuauauccaaauagcaguguaggagaauauacuuuacucacaccuucacaguauuggaaguuaacacuauauguaauuuuugacaguuaagcaggugaaagguguuuucuuacuuaauuuuccuggcuacuuggaaacuugaaaaucuuacuauauauuuacaaacguuuuuaauucccucuuccucagauuuucugcucuuacucuuuaucugauuuucuguugaauuauauuuuugucaguuugugggcaaccauguauguuuuacacauuuucuuauuugacuacuuuuaugguuucugccauuauuuccaucucauguuguaauggccaauauuaauuacuaaauuagauuuauugaaauuauaccaugccagcuugagauguccauucaaguccucuugacuuggauuuuuauaccacuuauuagcaauauugaggauauguuuguguaugaugcuuuauaaaauaaauuauaaaaacauaauguacuguuauguauaauagaauguaagcuaaagugauuacaaaauacacauuuuuaaagucuuaaguucuucuuuuuagaaagcauuuuguaaccuuaaugcuaugacuacuacuuuugcuuucuuguuagaguaaaauccuauuuuugauguucauuuggucauucuauuaaauuucauaaguuuacuauuuuauccaucuccgcuuuuauuuccucuacacuguauuuuuucaacaugauaaaaacuuucauacaugguagaauuaaaacaguuguacaaugaauacucaaauaacuaccagcuagacucuccaauaacuauuuuacuuugugugcucugucacguguauuuauuucuacauaucucuuuuuuuuuuuuuuuuuucuuuugagauggagucucgcuucguccuccaggcuggaguucaguggcacggucucggcucauugcagccuccaccuccugaguucaagcuucuccugccucagccucccaaguagcugggauuacaggugcccaccaccacgcccagcuaauuuuuguauuuuuaguagagacacaguuucaccauguuggccaggcuggucucgaacuccugaccuuagauaaucugcccgccucggccuccuaaagugcugggauuacaggugcaagccaccgugccuggccuaugugccucuucauucauuaauuuauauuuuuuauacauuucaaaguaaguugcagacauaaguacauuuucuaaacacugugguaugaacauaauuagcuagaguuuaguaguuauuuagaguuuuuuauuuuugagguaaaauuagcagugaaauggacaacuuuccauuuuaugaaccacuccaugaguuuugacuaauacauaaacguguaacccaaaucccucuagauuugcuguucuagaacuuugaaaaaauugaaucauauguacucuuuuuguauauacuauauguuuuugagaguuaaucacauuguugcauauaucauuaguuuguuuccuuuuuaaugccuagucacaugauaugcgguagacauuuuuucuuuagauaggaauuucuaguuguuaugacaucauuuguuuccuuuuuccuauuagauggcuucaaugucuuugucaaaaaucaagcgaguauaaaugugggcuuaugucuaggcuucccauucaaugcuuacuaguauagugugaaguaugcauuuuccucacacuaaauuuucaguuauugcagcaccauuugcauucuccuugcauugcuuugcugcuuuaguaaaaaaucaaaauacaauguaaauguggguuuauuuccaggcucucuauuuaauuuaauucaguugaucuauuuuucaauccugaugccaguaccguguugucuuaaauuacuguaaguuuauaguaagucuugaagucauguacaugguucuccaacuuuguuauuuuuuaaaauguuauuuaauauucuagauuuucugcacuuccacauaagugauagcaucugcuuugcaaucucuacaauaaagccucugcuauuuguuuguuuguuguuguuuugaggcagagucucauucuguugcccaggcuggagugcaauggcacaaucucagcucacugcagccuccaccuccuggguucaagugauucucaugccucagccugcugaguagcugggauuacaggcaucugcaccacacuuggcuaauuuuuguauuuguaguagagaugggguuucaccauuuuggccaggcuggucucuaacuccugaucucaagugaucugcccaccucaguccuccgaaguguugggauuauaggcgugagccacugugcccaccccagccucugcuauuuucgaaggauuaugcugaauuuacagauuaauuuggagagaauugauaucuuaacaauauugagccuucuaaaucaugaauguggcauaucucaccauuuauuuauauuuucuucaguuucucucagcaacgcuccauuguuuucaguucuacaaugaaguuguaauggacuuaauuuuuuugccuuuuccuuuuuauaggcucuggaucaguaucauuauacgagguagaaagaugucaacagcuaucugcuacaaguaagacuauguaucauuuuugagaugggcacaguaaugagcauaauaaagucugccucuacacuuaccagcuaauccauuucuuucuaauaguagaacacauauccuuuaaagcuaaaauauguccauauuuaacuuucuucuucuaccgugucuuguuggcauaaaauggaacccauaaagauaacgugucuuuacauugcauauuuuaagucaucuaucucuaacagacuuaauguuuaaaacagauauguuuuaaacauuaaauacaugauguauuugaagucauguaucucuguuagaguuacaugacuuaaaaugugcaauguaaagacacauaucuuuaaacuauuacaugaagaguuauccugucacaugaugcauuuaacaguguaccauaaaggagcuccuugcaauaugccucaaaauuuuaauuuaauguuaguaaugauagugugucuaucaaguacccuccuucugcuacaucagcuaagauuaaaaaaaaauuuucagaaaaauauuuuuaaccacaaauuuauuaaaugugcuauuguaaaaauuuuaauuucucaaauuggagaaggaagauaacaaaugugaauggaagaaggauugaugaaaucuuuuaauguuguguuguaauuggagguaccauuauguacucauguuuucuagguaaauacagaagucgauguagcuguguguauguaugauacgcauauauucacacguguacacauuuguuuauauuauaggggugugugugugugugugugugucaguaugaauguguguucauauguacccuaucucucucuccaugaaaaagcauagaggcagcagcacuccaguugccauaagcacaccuggugcucagaucuugguuuauaaauaauauuucucucuaaaggaaucagagcuccuuggugaaacagcagauuucugaacuagaacaagggaauuacaagauuaguauggaguaaccuuguacuagaaaguaaggggguucucaguuaaugaugaaacucgucaaauggcuuaggauagaacaugucuaggaacauuugagcaucaaaacaaauaauacuaauugaguaaagcaggaaugcaugagcccauguugaugaugauaaaggaaaaauaaaauauaugggguuaaguggaaauaucuuucuuaaaguaaaauaacaaauauaaaagggauaaugaaauuagaaaaaaaaaagcuaccauuuuguaaccaugauagucauuguugaguuaguugugaaucuguggauucuaaacuaucaggauauuugaugaaaaauaagauauuuacauuuucucuaguauauucuuguuaaauacaagggggaaacaguaaguuuuuaguagagaagugauuggacacuaccuuuaccagcugaauaaaguuuaggucuacaguaauagaaacacucacuuuguaugccccuugaugugaugcacugagaagcauacaguaucacuuacgcauuauuccugccaaaaaugcauaagcuaaaucugagccugaggaauaaccagacaacacccaaauugguguuuauucuacagaauaaauggcuguacucuucaaauauaucaguguugugaaagauaaagaaaagccgaggacuuauuuuacauuaaagaagucuaaagagacaugagaauuaaaugugauacaugguccagaauuggaucuuagacuugaaaauaaaaugaaugcuaagaagaacauuuugaggacaauuguagaaauuugaguaauguuuguuaauuaauucgauuauaguaauaaaucaguuaaauguucuaauguugaaaauugccuguaauuaugucaauaaaaugucuucuuuugaaauacauacuggaggauuuagaggaaaggaggcauaaugucugguaguuauucucaaaugauucaauaauauuuauguggugagagacagauaaagacaggcacagugacaaugauaaaugugcaaaaauguuaacaauuggugaaucuuggugaauauuauacagaaggucuuuguauuguuuuugcaauuuuccuuaaguuugaaagcauuuuaaaaugaaaaguuaaaaacuuuagguuaaaauaugaguuugaagcaauugcucuuaucacuguguagcaauguacacuaaauugaucaggucugccaauggccuuuuuuuuuuuuuuuuuuuuuuugaggcggagucucgcugucgcccaggcuggagugcaguggcacuaucuuggcucacugcaagcucugccuuccggguucacgccauucuccugccucagccucccgaguagcugggacuacaggugcccgccaccacaccggcuaauuuuuuguauuuuuaguagagacgggguuucaccguguuagccaggauggucucgcucucuugaccucgugaucuacccgccucggccucccaaagugcugggauuacaggcgugagccaccgcgcccggugccaauggccuuuuuaaaagcaucaccagcugggugcaguggcucacgcccguaaucccagcacuuugggaggccgaggcgggcagaucaccugaggacgggaguucgaagccagccugaccaacauggagaaaccccguuucuacuagaaguacaaaaauuagcugggcgugguggugcaugccuguaaucccagcuacuuaggaggcugaggcaggagaaucgcuugaaccugggagguagagguuguggugagcagagaucgcaccauugcacuccagccugggcaacaagagggaaacuccgucuccgaaaaaaaaaaaaaaaaaccacaaucgccaccacaacaaaauguuccacuguaauaaauguuccacucugauguaauaaauguuccacucugauaaaggcaagugagaaauaauaaaugaugaauauauuugggcagacucauuugucacagaaguaucuuaaauauaaacuuuauuaacugaaauauuugaaaagagguguaauuacuugaaauaucuaauuaagugauacagagagccuuguugguaaacuucuguccuucuuggccauuugcuccuugaaggaaaacuaauucaacaagaauuucauuggauuaaagcucaguacugaaaggaauugucuucgccauugagguuaauaagauuuguacaucauuucccuuuucuaaaacacaugaaaguguuaagcuagaauguauagcaagcuguugccuuaagcuaagggucaccagcaauuuuauacuuuuucccaguaaaaacugaucacuacaaucccaggccaucuuuccacaaguagcugaggagaccuauuguaccuauuucccaggcaauugcuccuaaugcuuuugucugaguuuuuuuuccaguuugacucaacuuccucuuauuuuuccucucccuccuccuccacucccuccuuccaacuccccaaacuuccucuucuccacuacuacaccacuccugugacaguuagaucacccuuaaugucccuuccuauucuuaaucugauuuuauaaugaugguucuguaaaaaguaacugauuugaaacauccaagagccugcaaauaauauuugcaaauaauauuuuacaaguguguuuuguuacauucuuuuguggcagacaccaguuagaacuuaaacgguugccuagcguaauauuuucuuagcuaaauaaaccuugcuuuuuugaaugcuuacuaggcaguuaaguuacuuauuucuucccccaaauuauccagcguuuauuuaguacacauuuguugaguaccuacugugccuggcacuaugcuagugggccuuggguauacaucagggaauaaagacauaacccuuccuuucauggagugacacuuaauagagcuuaaauuaauuagauuuuauaguauauauuugguucaggaggaugcaugucauaaauaugauucuuguuauucugauugaauauaaaaauucuuuacaguacuuacagaucaucaguauuuggagaggacaccacuaugugccauuuugaaacaaaaagcuccucaacaauaccgcauccgagcaaaauugaggucauauaagcccagaagacuauuucagucuguuaaacuucauugcccuaaaugucauuugcugugaguauuuuccauaauaaaacaaacguuuucauauuauuuguguguauauguacacauauguauaauuuugugucuuaggaauaaguaaauuguuaauauauauauuauauuuugcaagaaugguaaauuuuuuagguaaagugcuaaauucuuagagaauaaauuauucugauaguaauaaaagugggugcuauuuucagaucuaaaauucagcuuagucacucugauaaaggcaaaugagaaauaauaaaugaugaauauauuugggcagacucauuugucacagaaguaucuucugaaauauaaaccuuuauuaacugaaauuuuugaaaggaguuguaauuacuugaaauaucuaauuaagugauaaagagagccuuguugguaaacuucuguccugcuuaauaacuagaauauaauaaauauaauuuaaauuuucuuuaguaauugagaauuucucagugccuuuacucugaacaucagugauuauauaaauauguaauaaauguauauaacuguuuuguaauccuuuuacuacauaaucggcucaagacauauucugaaaaucauuuuuaaaagcuccucaucuuuuugcaauuugccuacuuuuccucugaauaucuaaaaugauguuuuggaaaauguagauaauugaugguuauaugcauuuggaugcccuaaauugagucuucacuaaaaugugcuacaauguguaaauaucuauguacaucgccauguauuugugugcuuauaaauugugaguaucuguguucauuaauauacauauauuuuccaauccaaaauuuggguuuguuugaagaaauuuuuuauuuuaaaaucucuuuaaauaaaaugugagggaacuguuuuuacccauuugagcuugaaauggugguugggauuaaaauguauauauaaggauuuuagauaauucuucaaauauuaucaaacuuugguuuauugaauuuuguaaaaucauacagcuuuguaaaauaaaaccacucuccgcgaucauuuuuuaaacaaauaaggauauuaucucagaaauuaacggaaacugucuaaaguuacacaguuaacuggcaacagaaccagaagaaagccauacaccuuuugauuccaaaugaugccauuucugcuacaugguaccuaaccauaugacuucuuaaaauuauuaauuauuaaacagaauuggaaauauuauuaguuuagaagugcccuucucccuaagugugguaaguggauauuuaacuggagugaagacggggccacugcauuuuuuucuccuacugggaaauuuagcauucuuuacagaggagaaaaaaauugaugcuagaaauaauuaugaguaacuuuguaucacaaaaccaggcauagaaaucacugguaguuaauguaaauaugauuuggauauacuuacccacaaaauaucaaauaauuaucuauugaaaaaaaguuauuuguucugcaaagugaauuaucuccauaauuuacauaauuuaagaaaaaguaacugacucaucuacauguaagaaugauacuuuuuaauuugauaacuuguuaaauggaaaucuucacgcuuacaccaaaaucgauuucuaucauuucauugccaauaauuuuaggcaagaaguuccacaugagggcgauuuggauauaauuuuucaggauggugcaacuaaaaccccagaugucaagcuacaaaauacaucauuauaugauucaaaaaucuggaccacuaaaaaucaaaaaggacgaaaaguagcaguucauuuugugaaaaauaaugguauucucccgcuuucaaaugaaugucuacuuuugauagaagguaagauauuuaagucacuguuuuguuagaauacuccuuuugcauauuuuuccuaauuaauuauuguuuaauacauuuuacagacaaccuaguacauauaaaguaaaaauaguauuuaaauuuaacaaaauugaauauauauguuaacuagguucaaauauauauaagcacacguucauaaauuuaucuuaauuacauuugaaauuguacuucagacucaaguguuaacauuuaacuauauuguuggauugcauuuuauuuugucaaugcuaagcugauugucuaguuaaguaauaauaaaagaggcugauugcuuauguaccauugcuguuuucuuggccucuggaugucacuguuguuucauagaaauagggugaaagucaucuauuguaucaaaaucaaagaagagaccauugaaacaaguaaagauaacuugacaaguuuuaaaugaaauuuaucauguuugguuuuucauuuucuuuucauuuucaucuaauuuuuaucucauuuaucuaaaauauguacugugaauuuuuuuucauggcaaauuuagaguuuuucuuaaggcuucucuucccuuguaaccuuuucauuguuuuucuuaaggcuuuccuucccuugaaaccuuuucauuguuuuucuuaaggcuuuccuucccuugaaaccuuuucauuguuuuucugaaggcuuuucuucccuugaaaccuuuuguaauagaagaaaaauaccuucuuuaauuugccuuagaguaauauuuaacuuuauuuuuaauaaaugagggaauucuauguaaauuauagacuuugggugauuaugugucaguauagguucauuuuuaacaaauguaccacgcugguagaggauguugauacuggaggaggcuagcauguaugguagaaggggauacggaaaaucucuguaccuuccucuuaauuuugcugugaaccuaaaacugcuccuuaaaaaaaaaaaaaaugaagucuuaaaaagaaaacauagaauguacaacacugagaguaaacccuaauauagacuggacuuugagugauaaugguuuguuaguaauguaaaguguggacuuugagugauaaugguuuguuacuaauguaaacuguggacuuugagugauaaugguuuuuuaaaauagguuucuugauugacuaaauuuaccacucuggugcaagauguugauaauggggaagaggcuaggggacauagggaaacuuuguaccuuuugcuuaauuuugcagugaaccuaaaacugcuuuuuaaaaaaggcuuauuuaaaaaaauaaugagaauguauguaaaagcacuuugaaauguaaaaggaauauaagaaaugugagcuauuuuuauuuuauguuucuaaguauuauaaccuggaccaagggcuaggaucuuacugcaguauggcacugcucugguuaggaaguaacaaaaucaaaaacugaccuggacuuagagaugaaccaaagaaaacgauauaaauacaaagucauucuuagacuuuaaggaccugcagcaguauucacugauauucaugccaaguuaaugcaguugacacuauuuuauugugaccauaguuuacauuaggguucacucauucugcuuuacaguucuuuauguuuugacaaaugcagaauaccauguacccaccauuagagucucauauaaaacaguaucacuuaauuucuguaaaagcucuaagaucuguguccagauuuuuuuuugcaugcagauguccaguuuuccaguaccauuucuuaaaaagacuguuccuucuccauugaauugccuuugcuucuuugucaaaccaguuugugugaauuugcuucuguguucucuauucuguuuuaaucugucuguuauuuuccuaauaucacaccauccuuauuucuaaagcuauauaguaauucuugaaauuguguaguguuuguccugcaacuuucuucuuuuucuugaguauuguguuggcuauuguaaaucuuuugcauuuccauguaaacuuuauaaucaguuugucaauauccaaaaauaacuugcugggauuuuuauuaagauugccagcugggcgcaguggcucacucugguaaucuuagcacuuugggaggccgaggcaggcagaucaccugaggucgggaguucgagaccagccugaccaacaugaagaaacccugucucuacuaaaaauacaaaauuagccaggcaucauggugcauaccuguaaucccaacuacucgggaggcugaggcaguagaauggcuugaacccgggaggcggagguugcggugagccgagaucgcgccauugcacuccagccuggguaacaagagcgaaacuucaucucaaaaaaaaaaaagauugccauaaucuauaagucacgguggagacagagaacuaacaacuugauguuauugacgaugaacauggacuaucuuucuauguagaucuucuuagaucccuuuaacuaggguuuuauaguuuuacucagauaaaccuuauaaauccaacaaaauauagaucacauuuuguuagcuuuauaucuaaguauuuucuuuuuuggugcuaauuauuuaauguuaaauucaaacuuugauuauuuauugcuuauguauagggaagcaauugauuuuuuuuuuaauuaaccuuguauccucuaccguugcuauaauugcuuguuauuucaggaauuuuuuuguugugauuuccuguaaacaaagacagcuuauuucuuccuuccuaauauguauaccuuuuguuuccuuuucuuacugcauuagauagggcuuccaguacaauauugaauaggagcaaugagagggaauguucuugcuuuuaucccagucuuagguggaaagugucaccauuaaauguaauuuuagcuguggcuauuuuaucgauguucuuuaucaaguugaagaaguuccccaauauuccuaguuugcugagaauuuuuauuauuaaugauguuggauuuuaucaaaugcuuuuucuauugcaucuauuaauaugaucauacaauuuuucuucuuuagccuauuaaugugauaaauuacauuaauugauuuugagguguuuaaccagccuugccuaccuaaaauaaaucucauuuggucauggugaauaauuauuuucuuuuuugauucaauuuuuaaauacuuucugaguauuuuuuuauguguuuucuuaagagaaguugaucaauaggucuucauucuuguaauguauuugguuauguauuagaauauugcuggccucauaagaguuaggaaacauucccucuacuuccauuuucuggaauacauaguagagaauuagugucauuucaguguuuggguagacuuagcuauugaaacaaucugagccuggugacuuuuuucaagauuauuauuauugauuuaauuucucuauagacauagaccuauucagauuaucuguuucuccuugugugaguuuugauagauuaugccuuucaagaaauggaaccauuuuaucuaaggugucaaacuuguggguucgaauuguuuauaauauuuauuuauuauuaacacuauauuuuaaacugcauaacauuuaacuuccucugaaacauuuuguauuguuuccaauugaauugaauccaauuuguauggaacucuaaugucacugaaucauuuuaucauaauauuuauuauuaauaccuauaauuuacugaauagacuaugugucaggcacuguacuaguuuaguauuuuaucuuuaacucucauaacaguucuucuguaagcuggauauauccccuuuguaaacagaagaggaaacugagaccaagagaaaauggugaaguacucaagguuaaagacuuaauaaaugucagaaaaaaauucaaacuuaggccuuucugucuccauaguccauguuaaauauuucuacugauugcaaauaaauugcucucaguuaggaugucuccagauacaaaccuugagaaauguaguaugcacauauauacauguaaaugucuuucuuuguucuuauucauuuguuuagcacauguuuauugaaugccuacuaugugccagacacugauuuaggcauuaguggcaauguagcaaacacaacaaaguucuuccuuucauggacuuuacauuaagaggaaaucacuaaaauauugauaguaauagucacucauggcucuaagugcuuuacaaauauuaacucauuuaaucuuuauaaugaucuuacagaguaacauuauucucaguuuugcaaauggggaaacuguuauaccagaguuuaaguaacuugaccaagguuguccagcuuaugugccagagccaaacucgugugacuggccagugugaaugacuagaugagcucucaccagauucuuugaaauaguguuuuuggggaggaacucauagagaaaagaguuagugaauggucaccuauugcaguuuugaacaguaggcaggagucucuucagcagggcuagguaucagucuccaaaagauagacuaacuuuugggcugugaaacuuuuaaguagcaugcuuagggaauauuguuuugaguuuuuaagcaugcauaaugagaguuucuaucuagcugcaauaugauauagcagaacucuggcuuccaguaacaaagagcuugggggaaggaggaugggaacagggcaaguuaaaaugccacagagcucaccguucuugccaaaauucagcccuuuuucuggagcaaacacuccuuggauuguugaaggccucugguaauuuccagaauucuaaaaaagguuuuacaguuuuugccaauauucuuacugcuguuauagucaagugugucuuuggauguccucacucugcuauaccagaagugcuucuccuuuauaauugaauguugacauuacaaauucuacccaaauuuuaggaaauacacagagguauuuuuuaaauccuuuucauuuugccuggagagaggaagcauuauuagcuaaguaaaaaggacacugccuucuaauaauggaugccauuggacaauacuucucagccagccuggucauuugaaugcuuacucugucauagaauuaacugugauaauuuucccaggaaaaaugaacaaauuuuauaugugaauucauauuacaugaacuacucauaucuauauuuaaaugaaauauugaccugaaaauugagauuuaaacucuaaauuugcccagauauuaauuaguauauagcaaauuagugagaaucugaucauaacuuagcuuuuaauuuauauucccucuuuugguuauuugaaccaaaguguuccugaaauaaagagcaauuuguuuaaauuuaagaaguugguuaaaauuucacaagcuuuauauuuuaccaaagucucagcauuuuugugcauugauuuuuuuaaucaauguauaggauuguacauuuacaaauuaauauuuuuuacauacauucauugucuuuuucugucaauuccuuuagucuuuuauuauaccucacacguuauuuaauaggacuguacuugucuacauuuuauuugcacuacuugaaggauuuauuuauucucuuaacaggagguacacucagugaaauuugcaaacucucgaacaaguuuaauaguguaauuccugugagaucuggccacgaagaccuggaacuuuuggaccuuucagcaccauuucuuauacaaggaacaauacaucacuauggguauuuuguuuuguuuuguuuuguuuuguuuuguuuauuauacuuuuaaguucuggggucaugugcugaacauggagguuuguuacguagguauacacgugcuauugugguuugcugcacccaucaacccgucaccugcauuaggcauuucuccuaaugcuguccuuccccuagccucccacccccugacaggcccuggugugugauguuccccucccugucuccauguguucucauuguucaacucccacuuaugagugagaacaugcaguguuugguuuucuguucugguguuaguuugcugagaaugaugguuuccggcuuuauccauaugccuggcaaggacaugaacucauccuuuuuuuggcugcauaguauuccauggugcguaugugccacauuuucuuaauccagucuaucacugauggacauuugguauaguuccaggucuuugcuauugugaauagugcugcaauaaacguacaugugcaugugucuuuauagcagaaugauuuauaauccuuuggguauauacccaguaaugggauugcuggaucaaaugguauuucuaguucuagauccuugaggaguugccauaccguguuccacaaagauugaacuaauuuacacucccaccaacaguguaaaagcauuccuguuucuccacauugucucaagcaucuguuguuuccugacuuuuuaaugaucgccauucuaaguggcgugagaugguaucucauugugguuuugauuugcauuucucuaaugaucagugacauugagcuuucuuucauauguuuguuggcuguguaaaugucuccuuuuaagaacugucuguucauauccuucacccacuuuuugaugggguuguuuuuuucuuuuaaauuuaaguucuuuguagagucuagauauuagcccuuugucagauggauugcaaaaauuuccucccauucuguagguugccuguuuacucugaugauaguuucuuuugccgugcagaagcucuuuaguuuaauuaggucccauuugucaauuuuggcuuuuauugccuuugcuuuugguguuuuagacaugaagucuuugcccaugccuauguccugaaugguauugcccagguuuccuucuaggauuuuuaugguuuuaggucuuacauuuaagucuuuaauccaucuugaguugauuuuuguauaagguguaaggggauccaguuucaguuuucugcauauggcuagccaguuuucccaacauuuauuaaauagggaauccuuuccccauugcuuguuuuugucagguuugucaaagaucagaugguugcagauguguggugguguuuucaacugagaaaacuuuuggaauuaaaaacuguugaagaguaauuuuuauuaguuuauuucauugguuacuauauguucagcaugaacuuacaguguaucaacuuauauguacuagguuuuucuggcauauaucuguucuuuugauaagcauauauagugagaguacacgcaaugugugaggcauaaggcugcugucuuuugauuccucagccagaggcugguacucacuuguuuucuuuaacagugaggauuuagauuccaguuacagagaaaaauucagagcugcaaaccuaguaaaaauuaagugauucaauuucagaauuucugagccacuaaauuacaaauuugcugccacugaaaauuggaauauaaaagaauucauuaggagcuauaaacagauuucuacauuuagaaggaggggguagggauaaaaucuccucuacugcuugaugaaacaaucacccuggacacauucugauuugagaaaccuuggauuauaacauauguuuuaucauccuauuccucuuucuuuccgacuucuacauuuguagcaauuaguagucauugucauaauguguaaauccugauugaaaaauuauauacugguugaaaaauauuauacgguaagcaugauaccucccuaauugugugguaaagucacuguuaggcauugcccucuguccuuccaacauaucauaaaauuuuagccauaaagcgaaaguguaugccacugacuuaaaucucuguguuauagcuguuuuuacugauauacucagugucuaauucucccucucauuagacucaugaucugagaguccaucuuuuuugaaaauaaaaugauuuuuaauuaagccaauuaauuaaaaaauuaaaacucauaaaauucaguuuuucuuguauaauaagucacugagcuuucucuuuuugcaugcucauccucgcucacuugcuuuuguucuuuccccuuucucucuauuuugccuugccaguacugggcaccgugacgcgucuaaaccaggaaaggaaauauucauauucauuuuaaacucugaaauacuacuacuucuuuuacuagaagucucaaaaaaauuaccuuaaggaccccauuuuuuuuuuuuuuuuugagaugaagucuugcucuauugcccagauaggagugcaguggcaugaucucagcucacugcaaccucugccuccccgguucaagcgauucuccugucucaacccccccgccgaguagcugggacuacaggcaugcaccacuaacacccggcugauuguuucguauuguuauuagaaacgagguuucaccauguuggccaggcugguuuugaccuccugaccuuaggugaucugcccaccucggccucccaaagugcugggauuacaggugugagccacugugcccaaccaaggcuguugacuuuuuacugguugcuucaaaacuaaggcaaaugcuguucacacuccagauuuuaagacauuuuuacauuuuuuauuacuugaguuucaucaucaaaagccaguauaucuuuuaauugauucuucuuuuuauuuuuggguuaugaaauaauuuuaacuuauagaaaaauuaaaaaaguaacaucacaacaauuacguauccaccauuuagauuuaacaaaucguaacguuuugacauuauuucagacuuuuuuuuuuuuuuuuuuuuuuggagacagugucauucugauacccaggcugaaguggcaugauuucagcucauuguagccuugacauccugggcucaagcaauccuacuaucucagccucccaacuagcugggacuacaggugcacaccaccacaccuggcuaauuuuuguagggaugggguuuugccauguugcccaggcuguucuugaacucuggaguucaagcaaucugccuaccuuggccuccaaacuuuuuuuuuuuuuuuuuuuuuuuauuuuuaagaaauuaaauguuacagagaaguaguauaaugccauaucaaucccuucucuaacucuuuuuucucagagguagcuacuuuuccaaacuuggauuaaauccuucucaucaauguuuuuaugccuucauuauaugugugaacucuuaagcaguauggcauauuuuucauuuuuuaaauuuauauaaacuguuucguacuaugccaagccuuuugcagcuugcuuuuuuugauucauuaaaauuuucaagauuuaccacuauugacgcauguagauuuagauuauuuaacaucuuuggaguauguuaugaaauaucagaauuuauuagccuauuuuccuauuaauggauauguguuauuuuuuguuucauuuacagaccauaaugaagucacguuauauguuuucuugucuauuucccuugucauaaaaugaguucagugggucauaaacaguuuuuuuuuaaauuauaugaugugguuguaguaaaaaauggaaugagagggaauggauaauagagaacauuuuacacaguaagggucaguguuguuuccuaaacuuucauuucaauuguauguguauguauguauuacuaagauaugauauuaaaugaauuucuuacugugaguccuuaacaaaaauguuugaaaguuacuccuaagguguuuaccugaaauuagaauuacuggauuauaagguguauauaaguuuugcuuuaugggaagaaauaccaaauuguucuucccaugguuuuaacaauauauggucccaucaguaauguauaaaauuuuaguuucuaccaaguucacuccaacacuugguauuagucuauuucugucugauacuuggcauuaauuuuguaauuuugucaggccagcgagcaucagaugguauccauaauguuuuuauuuguauuuccuagaugucuaguguguuuaagcagcccccguguuuaucagcuacauagguuuccuacucuaugaauuccauguucacaucuuuugccuguuuuucuaugugguuacugauuucuuuguugguucaugugugagcgcacauacauguaauugauuguaagguuucuuuccguguuagagauacuaaucuuugucaguuucauccauacuucuaguguauuccaugccuuuuuaacuuuaugguuucuuguguuuuauagguuuuuuuaaaauuuuuguuugguaauugcuuuauagguuacucucaucccuuugcuuucaaguuucuggcauucuaauuuguaugucacucauaaauaaaagcuuauggcuaaauuuuaguuuuaauaguggaguuuaaauauguucuuaaguuauugauauauuuaguuuauguuucuaauuuuuucuguuuccccuuucacugcuuuggaaguaaguaguucuguauuuaauuuugacuuaauauccuuaauuuuuaauuuuuauacuaacuuuaauaaugucuaaugcuaaucaauaucguagucuuuuucuuaggcaauaauauucuuuuguuaaauugacaucuuuuauuagaaaagaaacaccuauauauuuaauaaauagaaggguauaagauguaaugugguuacccucuuguuuuccucaaagugcaaaugaaaacaaauugcauggaccuuucgaacuuuuauuuuuauucaaguauaucuuuucaaguauauuuucuuaucaacaucucauaaacauuaugaugaugcauaauaaaaaauaaauuacucauaguuaaaauauguugguauucaaguaaagcaaaauaacuguacuacacaaugcacaacuuuaguguauuguguagucuuagauuuauauacauuucaaaaguuaacuauggaauuaggcaucauaaacuacaaaccucuggauaugugcuuacuaaaaauauuaauuaucuagaaucuugcauguugugacuguuuaguaauuuuucucuauuggccauauuuauuaacacuuugaauuuauuaagauauuacuuacagaggccagguaugguggcucacaccuguaaucccaguacuuugggaggccaaggcaggcagauggcuugagcucaggaguugagaccagccugggcauuguggcaagacccugucucuauaaaauuacaaaaaucacccaggcaugguggugugcaacugugguucuagcuacuuggaaggcugaggugggaggcucacuugagcccaggaggcagaggugacagugccugggugacagagugagaccuugucuuaaaaaauauauauauauagauauagauauagauauagauauagaucauagaaucagagaauucuuagagaugaucauuuucuucaacuuuucauuuuaacaaauaaggaaauugagagcaaaauuaauuaaugauuuggaccuggaaccgagcacccuguucucaauuuagaguuguuuauucugaaucuuauacugucuuuuuuauugcccuuauguaauaagcuuacucuuucauaauucucuugugaaacaaacaagcacauuacaauauaggggaugcaguauucuucuguuuaauaauuuauauuuuaaaacuacacauguuugagcaguaaaaaguuauaacaaacaagcuaaauuauuuuuaaauauuuaugguucuuucuuuuauaaauuucagauguaaacaguguucuaguuugagauccauacaaaaucuaaauucccugguugauaaaacaucguggauuccuucuucuguggcagaagguuagcuaaauuuccaugcccugcaauuuuaacuguuuguuuacaagguuauuucaccuacuuauauuucaguauaccugaaaguauaccuguuccuucuuuguauacuuauuccuuccucuguaagauaaacagacuuuguaaauuuaaagauaucugccaagccuuccuuuagucuguauuucuucaagcaggcaccgucacauacuuuccccuaugccuuacuauuuuguuuuuccuccucaguaagcauuccacuuuaccagugcuuuucucagaauuuggcauucagagcuggacauugugcugcagauguuguuuggccaauucagaauagagugaaauuauuauuuaccugaaacuggacacucagcuucuacuagccugaaaugucauuguauagcuauuuauuuguacacuugguuuuguuuucuuuccuuuuugauacagccaucucauguuuuauuugugguccagugaaauccuaggguccugucacaugaacuucuugaacuuggucuucucauucuauucuuaauguaauuuuuuuuucugucacaugaacuucuugaacuuggucucuucguucuauucuuaauguaauaucuuuguuuuuaugguuccugggaguaggugcuaaguucaucuuucuuaguuuuaguucacaguuuuaaccuauugagaccuuuugaagccuaaaauucaguuccccuguauuaaugucuguuguaugcccuaguucaugucuguauguccuaauuuauucuuacuuucccuguuaauuaguuauacuguuuaaauauggguuccacagauaaaagcuaauaaaacauucuauaaauugaguaucuuccauuuccaaacaagaagauauuuaucuuaaccugugaauuuucauuuuacccaguaugucuaauuucuuauuucuuccuuaucuuaccaaauuauuaaaucucagauucugacauucuuguccauucaaccagaugauaucccuuuuuucuuuuuuaaaguuauaaauuauuccccuagcuuauaauagaaaggagagaggcaugcuaaaacgguauuuaacugcaugcuauuuuuuagaauauucuguauuuuaauuuuaucuuucauaaaacuaacaugcaaugaguuacauuucaugaaucacuuuuugugguuucuauggaggcuaucaacuguuuuuuuuauuuauuuauuuuuauuuauuuugagacagagccuuacucugucgcccaggcuggagugcaguggugcaaucucgacucacugcaaccucugccucccagguucaagcaauucucaugccucagccuccagaggagcuggaauuacagguguauguuaccaagccuagcuauuuuuuuugguauuuuuaguagagacaggguuucaucauguuggccaggcuggucuugaacuccucaagauccgcccaggugaucugcccaccucagccucccaaagugcugagaauacaggugugagggugucaacuuauuuuaaauacguuaauauuuaaucaaaaagauuaaauugcuuaucauaagauauucucccuauguagguauagugaaauauuccaaaaugaaucugcuaaaugagcuuaauuauagguugaguaucuguggaguuaaaaacacaaacuguccucugcucugccaccacagcaaucagcgcagaagacuuaugugaccaaaugcauagggguuuucacccacacaccaagcaggcaaucccucagcagacgccagcuggguguccuccaguucaauucugacacuaucuaccuggagauaaugccaaguuuuucuuuguaucuugaguuauuuuaguaaauaaaauuuacaggucuauacuaucauaaaacaauuuuaacuuuaccuugauaauaaggaauagcagacucauaugguuugaucuuuuuuuccuucacuagcacuggguauuguaccccuccaauauguguuuguuaugaccuuuacacuugaugauggaacaggaguacuagaagccuaucucauggauucuguaaguaucagagguaauaaagauauuuuuaauuaaaaaauaauauuuaaaaaauugaauacauuuauucauaccugcuuuguuccuaaaaggacuuaaggcaccuuaaaaauauaaguaaaauaugagcacauaaaucuugaaucaucuguguauguaucucuuuuuuuauuugacacuaaaucuuaacauuugaauagugaaaaauuaaggaacagggauuuaaagagucauucccuauaccauggccaaaaugcagagauacggccacacuauggaagcauuauuuguagucaacauuuuaucguacuuuuguuuguuuguuuguuuguuuguuuguuuuuugagauggagucuugcucuguugcccaggcuggagugcaguggcacgaucucagcucacugcaaccuccgccucccggguucaagcaguucucugccucagccucccaaguagcugggauugcagguaugcaccaccacgcccagcuaauuuuuguauuuuuguagagacaggguuucaccaucuuggccaggcuggucuugaacuccugaccucaugauccacccacccuuggccucccaaagugcugagauuacaggcgugagccaccgugcccagccuugaucauacuuuuuaaaccuccacauuucauauuagaggaaugaaguuacuuuaacagggaagauagauauuauuguauaaaguuuugaggcagucuacaaaaccuuccucauuucugacacuaauugcaauuggaaguccucaaggccacucuuagauuugauaauucacaagacuccuagaacucacugaaaacuguuauacugacaguuacagauuauuacagcuaaaggauguacauuaaaaucagauaaugaaagagauguauaggacagaguccaggaaaguuccagacauggaacuuauaguuguccucuccccauagaguuguggacuguuacuuucccugcaacaguguguagcaguauacauaauauauugccagauagggaagcucugcuaaaagauuuuagugggacucuaucacguagguaugguugacugcccauauggcugaucauagucuucagccccucuugagaucaagcugauaccacaugcuccaaacuuuccacccuacaucauauuguuaaacuauucauagugacccagggcuuccaggcaaaaauacuucuaucaagugugacauagaaagggcuuagagauuacguuccacaagcuaaggucaaagcccagaccucucuuaggguaaaguuaaaauguuuacuacauggauuggaaaagaucugaguuauaguugagaggagaauuuuucucccaccuacacaauucauuuaaccuuucauuaaauauuuaaugagcaccugcuauguacuagguacuauccuaugugauggagacacagcggugaacaaaguaaacaaaauuccuuccuucuugaaacuuauaacauaguagggaagagaaaaauuaaauaacuauauaauacauauacuguauguuauauucauuuaagcuuagcacaagauuuuuuuuucuaugcacaaagagaauagucagccucauuguuuuuaaaucauuauuaccaucaucauuauuaaaucagagcaauuuacuugauuacguguaucucaaagcuauuuuaagauuaaagaguaaauaagauuuuggaguugagaccagcauucuaguuuaugaauucuacaaucuugauagagggaaacugucuagauuaucuuuuaauuggacaauauugaaauauguguuaauaauaacauuaaaaaggauuaauauuauuuccuuuuuuuuucucucaugaaacauuuuuaaggacaaauucuuccagauuccagcaucagaaguucugauggaugaugaccuucagaaaaguguggauaugaucauggauauguuuuguccuccaggaauaaaaauugguaggcaagaauauuuuaacaaucccacacuucuuuuacuugagauagcacuaacauauauguacucuguggacuuuuagaagucugaaagcuuugcuuccaaaugauuuacuaaguagugagugauuacucuaugaucaaccuuugaugaagagaguggcagggauaaaauaguuaugaaucauaauuccugcagucaaaagauuuuuaaaauauuuuuaaauauaggaaagggagauaguuuugaucacaagcacauuugacauugucaugcuacaagcauuuuaguugaaauuagaccaaaagugaugaauuguuggcaguaaacauuuucuguaacaaacuccaauuauccaauuuaauucauggauuaauuuuuuuauuuauuguuaacuaguuucagauuuuacaagcuuuuguuuuaccaauuuuuugugagcuuuguuuucugcauaaacauuugauuaauaaaccagaucuuccucauuucaaauuguacugcuuauaccugcugccacugaauuuuccuucugugacuauauuuguacuuauguugaaacuugcagaucuaagucauauuaagacaauuuugauuuuucuaacaauuuuuuaucguaggaaauuuuaccagcugcagauuuagcagcugguuuaauuuuuauauacuauuuuuaaucaggcuuuacucucccuggucaaucuuugcaucuuauaauaguuacauaaugauaggaauuuguguugaucucuaaccaaguuuaacuugaauaccuuuauuuguugucaguuuuaauuuguguuaacuguuuggauucuuuuggauagauuucuagaaguaagucuuuauauccaaaagcaugggccugguagacccauuguaaccacuauuuuagauuuuuaaaauauauaccaaccauuuugaaacccaagauguacucacuguuaccugcuuguggcaaaaaauucaaauuagucacaauugcuccaaaacaauaacaugaaucuaguauguauuuugaagagagaauaauguuaaauuuggaagggacguuuacuuacuuuucaagccaaaauaaauguuaauuuuucuagcucagugguaagcuuagguaccuauuucagaguuauuuauuuuguuuuaaugguuaaaucgcuuuuuuuguuuuuguuuuuguagaugcauauccgugguuggaaugcuucaucaagucauacaaugucacaaauggaacagauaaucaaauuugcuaucagauuuuugacaccacaguugcagaagauguaaucuaauauugccauccaauuuagcauacauaaaauguugccacucaccuucccuguuugagcuucuuuuccugaccugaguuuuguaucagcaauguugaugauguuagcauggguaugggauuagaaaauguccuuaccuuaaaucucuuggcuuuuacugggugcaagguaaauaauggcuauggauuuuguuuugcuuucuguuuugcuuuuguacaaagagaccugcuuaaacaaguacugcugagauaagugucugaucaagcuacaguguacuuuaaguagaaauggcaaaguugcuuuguuggggugcugauacugaugauuuuaggauaaauucauuucuuuaaacuuguaauacaugguuuuauugcuuguuucucuccaggauaguagagauuucucuauuucaccucaaccuaauaaaaguggucagauuuauaauguuaaugacuuaauauuauccuuuucuaauagucucauguaaaauaugccgcuauuacaacuuacaacuaauugaaugagauguuaacuuaguaaaauaguuugauuuuuaccugacaguguuugucaaauuuaaaaucaugaauauucaauuuuauacaaacauuuauauauauauauauagauuuguguauguuauuugccaaagacagauauaaauuaccugguuuaauauuagugaagaauaaauaagugcacacauuucaacuguuucauuuauuugcccuaaguugagcugaaaaaugauaugaggcaaagaaucgaaauagguguggcaaugcagcagauguuuagggcugucuacaucccagguacugugcuaagcacuaaacauguauuugauccucacagcaaccuauuuuuccgauaagaaaucugaggcuugauugauaagcugacuugacuaaguucacacaguuuguaaaagcuagagucugugccuuaauucacauaaucucuauucagagccuguacuguuaaccacucaaggauucuggaacagaagcuaacaguuuucugcaacgagucuuugacuuaaacaucugaaauaacauuggaaauagauuauaagaggagucaguguguuuuucuauaguuucaaaauacuuuuaacaucuuauugucaaaaagauuggauaacugacuuucuuugcucauaauaacucuaaauucuaguuccugaguacauuaacacaucuucuuuaccuaacuaccaaugucccccaucaucgacuuaucagcuuguuugagacaaugagaaagacugauuuuauuuucaagaauauagacucuugguucaaaacauuuucaggaaaaauauuuuaaaacccuacaguugaacagguguguuuccguguugaugaugugcucaggauacaaaggugaaauaaacauuuuuucugccuucaggaagcccucaaucuagaagaguagagguccaaaggugccauauguucacacugugagccugcaagaucuccacguuaacaaaggaaaacucuuccuaugaaucuucaugaugauaggccaugucucuucuuauuuuuguuuuaaauaaacauccaccuuaucauga

SEQ ID NO: 191588 - RNA, 33527 nt, Homo sapiens
acuuccggaaucucucggcgugugagcuugguuguccuaccaaagccagcguuucggcucgcgugcgccggccuaguuugcucgcguccucacgcgcuuuggguuucccggucucauggccggccugaccuuauuugugggccgccucccgcccucggcccgcagugagcagcuggaggaacuguucagucagguggggccggugaagcagugcuucguggugacugaaaaagguaggggcggggcggucgaggauagggcugggguuuccugcgaucgagggcaccuucccaaacuucagggagccguaucauucuuuacccuccccgaagagaagggacagggaacugaguuucuuuuccaaacugauucugcuuuagaugcguucauaggagucaguuuaugaagggcaaagcauucccuuacguuucuauagcgcuuucuguugauuaugcgcgcuaaaaaugaaaauaguuaacuagagcaucaguaagacuuauugagagucaccugauuggcagguacagugaucaguuugauacagguuaucucauuuaauuuucucagcaaucuuaccggauggagagucuuaaugucauuuuacagacaggaauccgggauuuaggggaauuuaguaacuuuaaguuuguacggcuguuaaguaguggacccccgauuugauccucagaccuggacaucuuagccaggaugcuauccacuuguucauucauuuauucagcaaauacuuaauaccuacugugugccaggaaguguuguagguccuggggaugcagcagugcacaacaccaaaccaaaaaaaucuuugauuuuaugucuucaagguggggaagagagccaauaaacgagccaauaaacaagccaaccgugaaaaugaugucaaaugcuaaggagaaaaauaagccagggaaagggguuaggaagucuaugugcauguguauaguggggagagggggugaagaguggcaauauagauaggguggccagagaaggacggacugaggugagagagugaacacaugccucuccggaggaagaacaauucaggaagagaaaacagcaagcucaaagguacugaaacagagguguuuuugguauauuggaggaguaguaaggaggacagggugacuggauugaagugaguaaagggaagagaauuaggagaugagaucuagaguagcagaucauguaagauuuuuuuuuuuuuuuaaagacugcgucuugcucugucgcccaggcgggagugcagugccacgaucuccgcucacugcaaccucugccuccugguucaacccauucuccugccucagccucccaaguagcugggauuacaggcgagugucacuacaccuggcuaauuuuuguauuuuuaguagagacgggguuucgcuauguuggccaggguugucuggaacucgagaccucaggugauccgcccgccucauguaggauguuauagaccauugcaaggacuuuggcuuuuacucagagauaggaagccacugauuuuaagcagagagcaguaagugugaucuggcauucguuuugaaagauucucucucuggcugguguguugccaauagacuguuggagaauaggacaaaagcuuauguacuuaaaauagggaccgaaaguccuguacaguaauguuuauuaaacugcagauuauuaccuauuagugggucuugagugggucaugacuagaguuuguuuuguuguguuuuagaaacagggucuugcucugucaacccuguugacaguuggagugcaguggugcgaucacagcucaauguaaccuuaaacuccugggcucaagcaauccuccuacuucagccucccaaguagcuaugacuacagacgugcuucaccaugccuggccaauuuuugaauauuuuuuguagagacagggucucacuacguuguccaggcugguuucaaaugauccuccugccuuggccucccaaagcacugggauuacaggcaugugccaccacgccuggccuagaguucuuaaaaaauuaaauaguauaggaguacguccauauaugguaaaggauaaguauuuguaaaacuuuuaaguuuuaaauaaagaauauauguauguacuggguuccaguguaaguagcauuccguacccaggugguuguauuccagggaagaauaggccauugaaugggaguucuccuuugaguccucagaauauaggcuacaugcaaucuuaccuuacaccuuguguacuuggucuaaauccuuaaaaaucucuuacuuccuuuuaaaaaacuaugcacuuuccuauccagacagcugauauguacuggaaagagugcugcacucagugaaacgggagggaggguauguggaaugaagucuuccucaauagcagugcaugucacuucaccucuuuaagaugggaauaauuucacaggguugucagggacucuaaauguaugugagcaugcuuuaugcagacauguaaaaugugugguauuuacuguauguccuuucauuugggugucaaacucuuuuacauuucagcugcuuuacuuuugguuguacugaucaugaagggcuaugaauuuucuugugcucauuuucugaaaggugagugggcagcuuuuaugauaaggaguucaagagaagagaaaaauugauguuauguugcuuuaaccaguuuauguagaucaguguccugugucaaagggcuuauacccugaaggagauucaaaugcaguggaaagagaagcagagcauaugaacuauguguccuuuucagguaaaggcagacuucuugaucuguccuuuuccuuuuugaugcaauaaauuauuuaaaauuuuacuauacaaaauguuaaaccaaaaagggcaaagguggguuacaguugauauuuguaguuuucaucuccuugguccuaauauuauucuuuguggaguccuauggaagaacaugggggcuggugaggaggaguuaauucagcuacuaacacccugugugacauuaaccaauucacuuacugucuuccaucucaaauuacuuacuuggaaagaaggggugauaauauuugcuuuaccuauuuugagguguucuaaagauaaaaugagacaagaaugcacagcugcuuuggaaagguuuaauuugauaucgacagcuaaggcguugguaauaguggucauaacaucugcagucucucugagcaguauuuauuguuugagguucuuuugucugggccucaggcauuuauugcugaucuauuuugaggaguaacugcauuauuguguucugauuuuugaagcuaccauacugucuuaauucauuuucuguugcuuauaagagaauaccugaaacuagguacuuuguaaagaaaaauuuauuucuuaaguucuggaggcugagaaguccaaaguuuaguggcuguaucuggugagagccuucuuguugguggggacucugcaaaaugcccagacagugcagggugucauggcgagggggcugagcaugcuaaugugcuugcucaggucucucuuccucuucuuauaaagcccccagcuccacucucaugauagcccauuaaucuauuaacccauuaauccauaaauugauuaauccauuccugaagacagaguccucugauccagucaccucuuaaagacuccaccuuucaauacugcuacauuggggauuaaguuuccaacacaugaaauuugggggacacauucaaaccauagcauauacuuaccuuuccugccuucuuuggugauguuuuguucuuuuugauguugaguucuuugagggccucauaugucauggauucucuguuuucuugggauuaucaagaaagggggaagaaggggagcuaacagcaaagacacuaaauuaaaagaggaggaaggcuaacaguuucuaagcaaaguggggagggaaccacugauaccacccuuguuucucgcccuccugagacuuuuggcaaacugauagcaagauggguuggcaguauauccucuagcuuaggcuuugaggauuuacucauuuagugcucuuggcuuaugauucucucuccuuuucacacugccccuccacucccuccccacuccauuauuccagggaguaaggcaugucgaggcuuuggcuaugucacuuuuucaaugcuggaagauguucagagggcccucaaggagauuaccaccuuugaagguugcaagaucaacgugacuguugccaagaaaaaacugaggaacaagacaaaggaaaaggggaaaaauggugaguuucuaguaauugaaggaaguuuuucucccagggugaggaggagcacuaugaaaaugaaagagggaggcauggagguagcuucuagaacuuaaagcuuuuugcauuucuuuuugaucuccaaaaucauccaguguauugugauacucauuuuaguucuuuggaaaaaucugguauuccuugguauuauugccacacuuaacccugugguaaaugccaucugucgccaguagcuuuuuuuucugugauguucuggcguagaagugggugauuuucgaguacuuauuccauuaccucuuauuuuuuagaaaacucagagugcccaaagaaggagccgaaggcuaaaaaagccaaaguggcagauaagaaagccagauuaauuauucggaaccugagcuuuaagguaagugagagagaaaaugaacauugcauguuuugaaggcuuuuagagccaagaugugaucauuaguagaacuccucaccaagaugguauaauugggcuuaauuccuucugggaaucaaccuuaccccuguugaauucagaaagugggccuguguaauaagggcacuaagugugaagcugcuuuccuuuuuggggaaacuacuacugagaaagaaaagguagaaaaaguucucagacgucuguguuuuugccucuuagguacaaaguaaaaugucuucuauuuagaaacauuugauguccuaguaucaaaaauaaaaaaaaguaaacauucauguuuuucauaauuaaugaauuuaguaguugauguuuuauguuaauuugcugugauuguguuucucuuuuucuuucuucacuuuuggcuucaguguucagaagaugacuugaagacaguauuugcucaauuuggagcuguccuggaaguaaauaucccuaggaaaccagguacuaauaaaccuucacuugguguggauuacguuaguuaacauauuacccuugaacaaacauauaugauauauaugaaguauuuggcacagugcuucacaucuaaugaaaacccaaauaaugguuuuauuccccugaugauauuuucuguuggaucagaauuaguuuuagaaggcgaguuaguuugagaaaguguuuugcucuccccaaguccaagucagaguauacucaguaagaagauguaagcaauugcuuuggggaagggccugaccugcuggcagaauuugggccaucuugugggccugaauugcaguaauuuacuucuuaguauucuggcuaccuccugcugccucucacuucuuucuuugugcauuugcacacagaugggaagaugcgcgguuuugguuuuguucaguucaaaaaccuccuagaagcagguaaagcucucaaaggcaugaacaugaaagagauaaaagguaagcuuucuauacccauaucauugacccagauauuucugguguuuuggugaauuaguguaguaacccacuuucugcauuuucaaaagauguuugcauuauuaagagucucauugcuaauacgguagcuauuuaggugaaauacucuagaacuugaucuugggguuaaacuugaaagaacccuugccaguauucuuucuuuuaucuggugagaguguccuuuuaaaucccuagugaaaaaugucccugagauaauugcugauagaugcagguugguaucuagauuccuccuugguuauaucacuguucagcaucugugggcuauuuauuaaacugacugugauuuauauauugacuuaucaaguacugugccuaaagaaguuauugccggccaggugcgguggcucacaccuguaauccuagcacuuugggaggccgaggaggcagguggaucaccugaggucaggaguucaagaccagccuggucaacauggcgaaaccccgucucuacugaaaauacaaaaauuagccaggugugguggugcaugcuuguaaucccagcuacucaagaggcugaggcaggagaaucgcuugaaccuggaggcggagguugcagugaacugagauggcaccacugcacuccagccugggcgacagagcgagacugugucucaaaaaaaaaaaaaagaaguuauugccguagagauguccuagcuuccagguagggugcagaugauuccagaaugccuguuuugauuccugauagucuaacuggaaacauaguucuaauucuuuauuuuuuuacuccaucuuaucccaggugugguggcuauguagaaaggcaaaauuucuguucauugauaaaaagguuaaggguuaaaaggaguaggcagugacuaggagcuuuauuuuaagaccagcauucccugaauuggcaguuucuuugucuccacugguuccauuauugucugugaugacuaggggucauuuacagagguaggguuuuuaaaaggagagccuuucugaugccacuuuucugcuugacaggccggacaguggcuguggauugggccguggcaaaggauaaauauaaagauacacagucuguuucugcuauagguaagaugugguaguguugggugaguaggggcguuguauaaccugggugagaguauugaaacaacuccuguguucaugauaaaaguguaagaaaaaggcugggugcaguggcucuugccuguaauuccagcacuuuggguggauugcuugcagucaggaguuugagaccagccuggccaacaugcaaaaccccaucucuacuaaaaauacaaaaauuagcugggcuugguggugggcgccugucaucccaccugcuugggaggcugaggcagguucuugaaccugggaggcagagguugcagugagccgagaucaccccacugcacuccagccugggcaacaaaacgagacuucgucucaaaaaaaaaguguaagagaaccugcuuaucagaguaagacuauuguggaagauuaaccaaaagaaugagacugggcuuucagggaaaacucugaauuccugcuggcucagaagugaguccaggucuguuugucaauucauauuguaccauuuggugcucuggucccaaaaccuaggcucuuuugagucuaagccccuuccugggaguggcugugagugagccugaguucacuguccccuuuacuugcuguuguuuccaggcugugcauaauaggagugauggaacauuaagaauagagaaacuuaaaacuugagguuuauuuagaaaacaauuggcugguaagccaccagggucucagagaauagaacgcacugagauuaaaguucauggcuuggcuuugcccccuagugagcauuuugcuggcuaugauguacgaaugguagacugcuuggagaggcucaguugccacuucuuucagucugggccagaugaaccuucagacugaugaaugggacaaacucuaaaggaaucuggguguugagaguuuuguuuauuucuguuuuugcuuuuucuuuucuuuauacuuucuccuguuauaugcaguaagaaaaauauacgaaauucuguaaaaccgaugaaaccaagaacuuggaguauugguuacuuuuguuaaaauaacauuguuuuggauauuaaaugaauuccuccuuucuuuaccucccuccauaggugaggaaaagagccaugaaucuaaacaucaggaaucaguuaaaaagaagggcagagaggaagaggauauggaagaggaagaaaacgaugaugaugacgaugaugaugaugaagaagaugggguuuuugaugaugaagaugaagaggaagagaauauagaaucaaaggugaccaagccugugcaaauucagaagagguaagcagcucauccuguucugagacagcagaggaagauucaagauugucuccgagaggaaaaauucuccuuuuucugccugcaucauugcagaauugacauguguaaugaaauugaauaggcccucugucagcccaccuccuuaguucugaucugugccauugcagagcagucaagagaccagccccugcaaaaagcagugaucauucugaggaggacagugaccuagaggaaagcgauaguauugaugauggagaggaacuggcucagagugauaccagcacugaggagcaagaggauaaagguuuguuuggauuuucauaaaugucuuuagacuuuaaaaaaguuacugaaguuacggaaaugagcaucaguucugcuuagaucucuuuuuaaauaggacucuaagguguucuaucaaauuuauguuuaaaugcugaaaaggaaaccuuuauacuccuuucuuccaaagguuuuuuuguuguuuccuuuuuguuuguuuuguuuuuuaagugaguuuuggagugguguuugaggguuaagauucuuagggaauugaaaaccuagcuuaaugcugagguucuaccucucucuggauuguccaacuugauagaauaaccagguaaacagcaucuuauacagauaauauagaugaaacagaugauauaaccaucucaacaucaagcuagauuuuaaacaacuccuuggaguugagauggggauaaagaacuguuuagucaguuuggacugacauaacaaaauaccauaaacuggguggcuuaaacagcagaaacuuauuuucucacagcucuagaggcuagaagucccaggugccagcugauucauuuugggugcagcucucuuccuagcuugcagacugcugccuucucgcuaugugcuugcauggccuuuucuuuguggcuugacgaggggagagagagaacaaguaacagugaacucuggucucucuuuucuuauaagcacagcaauccuaucagauuagggcccaaccuuaagaccucauuuagcuagccucaguuaccucccuaaagucucugucuccaaauacaauuauauuugggguuagggcuucaauguaugaauuuugggggaacacagugcguuccauaacaaggaccucuuugaacauguuguaaaacuuuagccaauccuuauugcuaccuuuauugagaauaaauucaacuuguuuauugaggaaggcaggucauuacagaaugagaaauggcuaauaacugguucuuugauuugucuggguggagauuuuuauuucagcuguuuuuauucugauuccauuucaguaagucugacauguugguuugaccauauaagaaaucugaggaaauaagcuuuuucugugaggagagaaugguauacaccuuagaaucaaagaagcuucuacacugaagggacucugagauccuguauucuacaacccacagucagcugucucaugccauucuuucaccuaaaaaacuuauaggacagauaaaugauaaugauaaaaaguuaaaacacaacacagaagaguguaauacacaaaguagaaguuucucaccaauccuaacaauucccugaaguaaucacuguuguuucuugugcauccuuccagauauuuucuuuguauguauaagcuuauaugucuguucuugaaaacaaacagugagucucccuuauacccagauccucagcuucuuagggaacuuccccagagacaaccaagguuauuuguuucuuguguaucuauagauauuuuaauacauuuauaagcaaaaugcacacauauacacacacauauacacauucaaaauguaguguauuuuauaauuugugugugauuguauguguauguuuuuuccucaaaguuuccuauguccuauacaguauuuccagaaaguuuacacugucauaguaguauauggaaaugucuuuuucccauaaccuuaccacauuggauuccaucagucuuuuugauuuugcaaucuguuggugaaaaauaguaucucauuucuugugcuauguuuucuuuaauuaagagugaguuugaacaucuuuucauauacuuagcauguccuuugucuauuuuuauuuuuauuuauuuauuuuuuuugagacuuuguuucgcucuugucaccguggcuggagugcaauggcucaaucuuggcucacugcaaccuccaccucccagguucaagggauucuccugccucagccuccugaguagcugggacuauaggugccugcuaccacgccuggcuaauuuuuguauuuuuaguagagacaggguuuugccauguuggccaggcuggucucgaacuccugaccucaggugaucagcccgccugggcuuuucaaaguggcaugagccacugcgccaggcuuaucuuuauguacuuaagaaguuagcucuuugucauguggcuuacacuaaucucuuucaguuuguuguuuuucuuuuuaccuuagcugugcaagucucaaacaaaaagaagaggaaauuacccucugaugugaaugaagggaaaacuguuuuuaucagguaugucuuucugccuccagaauugcuuuugcguggucuucauagaucucucuuccuucuucuucucuuuuuggcacuaguucuguuaccuagcccagaaauuagaucaagcacaucuggucccaggaacauacuaaacaaugagaaauguaggacaaucagaacuauaacacagaagacagauagcauggguccugacaucacguuuucauuuagauuucaugcuuuguaauuggguuggcaucauuuggaagaaaucaguucaacuguuagaaacaucuugcuuccggccuuuguuuuagggggagugcuggagaggauugacacugcuugucucaaaugauuucugucuuuaugccuaacuuaucuucugaugcaguguccagaauaaaguaaggcaucucaucuguuuccaggaaaacuaggugggaguggggguggcaauaggcuuuauuucguguugcuguuguguuuuagcucuacugacugcaauagauugcugcuuuuaugaggucaggaugucuucaguauaccucaggccugccuucuaguccuuaaguaccaguguacuagggucauuugcauccgauuuuagaguuauauauuuuaucuucuuguacaaucuuuuagaauuauuuucuugggugcgguggcucaggccuguaaucucagcaccgugggaggcugaggcagauggaucacuugagggcaauucgagaccagccuggccaacauggugaaaccccauuuuuacuaaaaauacaaaaauuggccaugcaugguggugugugccuguaaucccagcuacucgggaggccugaggcacgagaaucacuuaaaacgcagagguggagguugcagugagcugggauugugccacugcacuccagccugggcgacagagcaagacucugucuuaaaaaaaaaaaaaaauuuguuuucuuauacaauuuguguucauucuaggaaauugaugaaauacaugagcaaaaagucaaaaaaauuaaccuuaaucacuacucagagaacaucuacacuacaugcccacaucauaaagauucacagagaugaauuuauacaugcuauacugaagcccauuuucucaccuaacugcaugucuuuccauguguuuuaaaaauuguauuauuuggaacugccauauaaaugauuuuguauuugcggaggaucugucuaacaggaaggaagaaaugucacagugaagaagaagccugugaccucaguacuaaggauaccauuccuuauacaccuuuuaauaaagaacuuagggaaauaaagggguggaagagagaaaacuaugucuaucuuagauaaggcaaauuaaaagaaauaauguagcuaggauauguuuuauugcagaaaaccuuuuuuaucuggguuauccaugaaauagaaucauucauggggcuauucagugcauauaagagaaguaaaauuacagauacuuauuagggacuguuuugcuuaccccuggaaggauuuacauaguuggggaaaugaggaaucuuuauacuguguugaaauuuuaggacaacaaaauuuccuuccaacauuuuuuuaaucccaucgagagaaguaaguaguugucuuuuuuugaacuuaguaaauuuuacuguauuugcuuuuguguuacuauuuugagggauuuuucugacuuuaguaagauuuuaauugaaaccuggauuuaauagcaacacagaggaaaaaauggcuaauuaagagagauaauuugacuuuucucacuagucugcugugagucuucuaguuuguaguaagagaaaugaauuuuggucaauuuaaguggaaaaagaggguuucagaaucaaaguugucaaagagcaagccucaggaagagggugaaaaucugggcaguucuggggcccuaggugauggaggcugugggucuuuucucuggggacaccacuuuuuuuuuuuuuuuuaagguauaacauagauucuguaaaguacauuaaucuaagcauauagcucaguuaaaauuuuauauguauacauccauguagccaccacccagaucaagauguagaaauuuccagcaccccagaaguuucccuagugggggggcaccgcuguuuagaaaugaaucuuuaccugcaguuucuggucuuuguaugugucuguuuacguuuucagauuccugagaaagagaaccucauugacaaaggaaagucaguuggggccaagggucacugggggccaucccuauguauuagugcuauuucugaacaagggagaguugauaucuaacucacuuacauuguccuggaacauaggaucucacuuauguaauugacuuuucuugugaucaucugguuaucuuccauagaaaucuguccuuugacucagaagaagaagaacuuggggagcuucuccaacaguuuggagaacucaaauauguccgcauugucuugcauccagacacagagcauucuaaagguauguguugucagcuggccaggcccuaaaaggguugagaccacugccgugggcacugacuagguuacgagagcauaaugugugccauuuugagggguucacaguccauccagcccagguuucuggguucuauaaaaguaccagggacgccgggcacgcuggcucacgccuguaaucccagcacuuugggaggcugaggcaggcagauugccugagcucaggaguuugagaccagccugggcaacacggugaaaccccgucucuacuaaaauacaaaaaauuagcagcgugcaccuguagucccagcuaccugggaggcugagacaggaaaauugcuugaacccgggagguggagguugcaaugagccgagaucaugccacugcacuccagccugagccacagagcaagacucuuguuuccacgaaaaaaaaaaaaaaaaaaaaaaaggaccagggacauccuggucuuuaauggugucacacucagcaucuuuaauggugcugcuagccauaauuuugucuaagcuuuuuaaucccuugcuuauuuacuuuaggguaaugaauuccauuuuugcucuuugcauuucaaaugugauaguaucucauagguacuaaucauuccacauugcuugaaauuaccaggaucuuuuuuuuuccuguugcuuuuguuagagguagaagcugacagaaaaacucuguugcagugucagccguuagaaggaaaacucuauguugcaggagugcugccuuagauuucuuuuuuuuuccaaaagcuauuucuuuugaguuuuaagcauugaccauucuucguucuaguauacuguuguuagguaaacaucuuuccaacccauucauaaucuuugauuucaccuauugcagucauucuccuaaagcacuaaguucuuuuuuuuuuuuuuuuuuuuuuuuuuugagacggagucucacucuguugcccaggcuggagugcaguggcgccaucucggcucacugcaagcuccgccuccuggguucacgccauucuccugccucagccuccugaguagcugggacuacaggugcccaccacugcacccggcuaauuuuguguuuguauuuuuaguagaguuggggcuucaccguguuagccaggauggucuccaacuccugaccuugugauacacccgccuuggccucccaaagugcugggauuacaggcgcgcccggcguuaaguucuuaauuuauugugauucaugauucguuugagaucuagcaaaagcugugaauccucuccuuagaaaaaugcugcuucggaggcugugugggcucucuugagccuauccacagcuuaagaaccuaccuccauucuaagccuuuuuaucuuucacauugauagaaccuaaucacuuuugauuuuuacucagcuaaaaaaaaguaagaccuggccgggagcgguggcucacgccuguaaucccagcacuuugggaggcugaggcaggcggaucaccugaggucgggaguucaagagcagccugaccaauauggagaaaccccaucucuacuaaaaauacaaaauuagccgggcgugguggcgcaugccuguaaucccagcuacucgggaggcugaggcaggagaauugcuugaaccugggagggggagguuguggugagccgagaucgugccacugcacucuagccugggcaacaagagcaagacuccgucucaaaaagaaaaaaaaaaguuuaagaccuggugugugccugaaaucccagcuacucaggaggcugcggggagcccaggaguuagaggcuucagugagcuaugauugccacugcacucgagacugugagacagaacaagaccgccuccaucucuuuaaaaaaaaaaaaaaaaagaugugaauaaggcagcacuguggaacagaguuagagaucuaaucccagcuaugcuacagauagacugggugauuuuuggcaaaucauuuaacuaccguuggcuucagguuuucaucuguaaaaugaguggguuugaguaaucacuuaagguaccugcagcucucauguuuaguuauacuacuuggaucuuuuccauuucuaaaauguuuuuagacaauuugaauugcauagaauguuccaaguuagugguaugauauugcuuuacuuuggugguaguaucuuuugucucuuuuuuagugcaguaguauauuggguuaauacuuuuagaaugaagccuacaauugacugacuagauaucccuugcggucuauuaauguuaacagaguucaugaucuuaauaagcauaguuuuaaucauuuaaaaaaaauguauuguccuucccuagcucauuaaauuuuucugauaccuuuuuugccuacucaugcagccucgugcugcuccuguaguuuaucccucucagcaugccauuucacuaccuggaagagcuaaguauuaacugcagucuuuuagggaaauguuaagacugaacccaguacugacucuggaaacuccaaugauaaaauucuuacccauucagagagaagcacccauuuucuucauauucaaucuaauuagauucauuugaaucugccuauuagaaacauuuuccccauauuuccuuauuuguuucuuucuauugaguaucuguuaaugcuguacacuauaguaggugcuagggauauagaaacagauaagaauuguggucauuuuuccugagguauucauucuguuugggaagaugucaccugaguagugcuauaauaaagaugugaguggaagauaggaggcaggaggggacacagaagcuucuagauggugaccuuuguguuggccuggcgcauguguccuuucaguuagucugugccauucauuuuuauaggaggcagaagaucaaugcccccacuagcucuaggaaauauggcagcaucugagagaauauuuaaaauuuaaaggaauacuaaacaaaauuaugaaacuuguauuucuuuuuuggaaucuacugaaagguaaacuuacuuucuuugcuuauaaaaguuguuuuuuauugaccgggugcaguggcucacaccuguaaucccagcacuuugggaggccaaggcaggcggaucaccugagguugggaguucgagaccagcuugaccaacauggagaaacccugucucuacuaaaaauacaaaauuagcugggcauggaggcaccugccuguaaucucagcuacuugggaggcugaggcagaagagucacuugaacccaggaggcggagguugcagugagccaagauugagccauuagacuccagccugggcaacaagagcgaaacuccgucucaaaaaaaaaaaaaauuguuuuuuugucaauagcagaaauagagauggguuaauugguccugcaucuaaucaaggaaaggcaugccuuauggagauucuagaguaugagccaagaauugagcuccuggcuuucugguucccugcuauauucauauaguagaggacagagacuuuuacucugagaagcagaucugcccauaucugaugccucccaagugacugugugacagugagaucuguaauuaaguucaggguuaagugguuccugcuuuauuuuuuaguccucuaauagguacuucauaagugaugcugaauuaaguguuaggcuggaauuucucuaccauuucauguggauauuucuuuucuuuucuuuucuuucuuuuuuuugagacaaggucucgcucugucacccuggcuguagugcagugaucauggcuuacugcagccuugaccucccgaggucaggucauccucccaccucagcuuucucgguagcugggacuauaggcaugcaccaccacacccagccaauuuuuuuuuuucuuucguagagacaggguuuugucauguugcuuaggcucuaacucuugggcuuaagcgaucuuccugccuuggucuccuaaagagcugggauuacaaguguaagccaccacacccagccuucacauggauauuucuuauuaagagagaucaugagacuaaaguucuaagaagaauuagaacagaugaaggaaguaauaauaaaauuucauuaagagcagugguaucuuugucuugauuauuugguaccuaacauagugccugugucauagugcaauaugcgucacuuaaugauggggauacauucugcaaaguucauuauuuggugauuuugucauugugugaaugucauaguguacuuauacaaaccuaggugguauggccuacuacacacauaggucauaugugcuccuaggcuacaaaccuguacagcacagcauguuguuauacugaauguuguaggcaguuguaacauaaugguaaguauauguguaucuaaguauuucuaaacauagaaaagguauaguaaaaugcaguauaaaagauaaaaaaugguacaacuguauagggcagauccauuguaaucuucugggaccacuguuguauaugcagucugucacugaccaaaacguccuuaugcaaguacauggcuguacuuuuuuuuuuuuuuuuuuuugagacggagucuugcucuguugcccaggcuggagugcaguggcacuaucuuggcucgcugcaacuccgccucccagguuuacgccauucuccugccucagccucccaaguaacugggacuacaggugcccgccaccacgccuggcuaauuuuuuguauuuuuaguagcgacgggguuucacuguguuggccaggauggucuugaucucuugaccucaugaucugcccgcaucggccucccaaagugccgggauuacaggugugagccacugcacccggcuacauggcuguacuuaauaaauggaugccaccuaucccuuccacucugugucaggcuguugccauuugcaauguugucuuugguuuaucugugggaguuugggaucucacugaauugugucuccuugugcagguugugcauuugcccaguucaugacucaagaagcagcucagaaaugccuucuagcugcuucuccagagaaugagguaaggaagauauuuccuuuaccuuauaacacaggaggcaguuuggcucuuaggggcaacaucugguauuuauacaaagcuuuauuauuauuuuucuugucaguaauaauaaaacuaacacuuauuuagcacuuuguguuaggcacugaacuuuacaugcauuaucuuaaucauuacaucagcccuuugagguaggcagaauuaugaucucuacuucauaggugaggaaaaggggauaauaacguaucugauauuuguugcuugcugucugugucagccucuauccuagacugauaacaugaaagacuaggaugagguauuaaggucgucugugaaguagaguagauguuugagagagaaugugugugggugauggagaauuacuccauuuguucuauagucgaguauaauguuaucuaauauugcuguuauuucuuaaguccucuugaguaaguacucuacuauuucacuagcuuacuuuacaauacuagacauuugccugguuacagauaauuuuccucaguuugggucuacuuugggacuaaucaacucccagaaaauaaauucuuuacugcugacugccugaaauacacauguggccuuuugcacagcuauacuaaauauugugaggcccagugauccauuuguagcuagcugagcugaaacgucguagggcuuggcuuccauagcguaauugauguuugcuguaucccuuucugugguguucuugucaggugcuuaguuucuaguuucuacucauuauguguuguuuuguuuuguuauuuuuuuauuuuauuuuauuuuuuuugagguggagucucgcucugucucccaggcuggaguguaguugcgcgauguccgcucacugcaagcuccgucucccagguucaugccauucuccugccucagccuccugaguaggauuacaggcgcacaccaccaugcccggcuaauuuuuguauuuuuaguagagacgagguuucaccauguuggccaggcuggccuugaacuccugaccucaggugauccaccugccucagccucccaaagugcucgguuuacaggugugagccacugugcccggccauuauguguuuuaagaaaggguugugaucuguuacaggcuggugggcuuaaacuggauggccggcagcucaagguugacuuggcggugacccgugaugaggcugcaaagcuucagacgacgaaggugaagaagccgacuggcacccggaaucucuaucuggcccgagaaggcugugaguagggagauguaacccacacuucuaaguaccuggcccugugccauaaucauugaucaagcaauaguaugccuggaagcauguuucaaauuaaaaacccaaauguucucuuuaacaguguuauaugaucauuccacuuuaauaaauguggcucucuauuaguaaaccuucacucguuuuuguggauuaacugucccauuaucuuuucugccugguugccuuuagucuuuuucaauagaggauuggcaaggcaaagggggaggaagaacucaaaauaccuuugcuucuugucaucauuucuaauaagagguuuucauuaugacuaaaauuacucuuuuggauuauucauggauuuaaaaugugcacccaauacuuuccuuuagugucagaaagacaaaaaaauuagcuuuaaauuuuuaaaaaaauucuucuaggucacacagcauuuaucagcucaccuccuccauagcuucacagccuguacuaguaauguccuuuagccuucgacaccagccuucuauggcaacauaacuguuuucggcuggcuuaucucacuguuuaguaauggaccucaaguauauaaggaacagcaaaguuaaguuccaagggcagauuauagguggaacauugugcauucuaaaugcccaaaauguacuuauguuccauacuucuucuaggccuuucuuucugacuuugggcauguacgugaagauucuuugaggggagagaaggagaagaggaauaaaaucacaaaauguuuagaguuuuaguccuugagagcagcucugagcccagaacuuagcccuguagccuauuucuggaccuaaccaaaugccaccguguccuggccaagauaguccucugggcccuguacaaagaguuugcaucauucaaaucacauuccucuuguugcucagugaaaauucccuuguugaugucuuggccuuuuucccucuuucugcagugauucgugcugggacgaaggcugcagagggugugagugcugcugauauggccaaaagagaacgggugaguagauuaggcauugaccuucacguucugcguggccuauaaaucaaucaaaaauaguuaucgaaugcuagaugugcucaucaaagagcccaguauggucacagaccauacuuauugcccuguuagggagaaaagcacauaggugaaauagcaaguaacccaacaucauacauaguauucuaucuguuuuguaugcugguauaaaagaacugugucuuauuauuuguuucccuagugcuuggcaguaaauguuugcugaacacaugcugcuacaucaugcaguagacagucagaggcuauugcuacauguaauuaggugucaguauaaacacagaauaauguaaaagaggaagaucagaaugagcuggaguuauuagagaagggagaagauauggcucuugaaagggguagcugucaguugggaggaguuauaaucuccagauuauaaaaucauuuuagaaaaacuccauuuuauggauguuuccgauguuaaccgauaacucauauuccuuugcugcuugguaauguucccaguaauuuuuacuuuuucccauauaacuuacuuucaaaaagccaagccagccuagaaggguaaagaugcauaacugugaacagaauuagcuauggaaccuuaacaugcagaugaggaacaggggugagaguguaaugacagcaggaggcagugcgucuuuuuuucagugggcacagauucugcacuaguguuuucaacuuuugugguagugaacaccuagaaaucauaggcucuggagacccauccuuaacuggagaaauuacagaaaauuuuaaagccucaauuuuauaagggcacuauauacccuugucugaucacagugcaauaaugacauauuuaauuuaaaacuaauuuuguuagcaaaaagcucauucaaugauagguaugcauuauaaauucacagcaggcacagcuuuuccugacagaaaaauagucuguugaacuuaaacaugauagccuuuucagauguuccuuuaauagucguuuuccaagggauuuguuuauuuugugaucuguugguacuuuuaccaaacaagaagcagcaggacugagaagacuugacaaaagaaaaacuuuuaauugaaaacuuuuuucuaccaacuugguuuaaaaaaaacuaauugggagaagaaugucaucuuucauuucauuuuagacacagaucacgcaggaacugggguuuuguggcagcauaguugaggguauugcucuaagagcaaaauaugguucuguggucauugauacuccuuugccucaggguggcagaguugagacaacacagcauucugucaaguauucuuugaauaacuuccauuuccuuuuggaaggauuagauaaucaguugagcugguggguagaugaggacugggcauagauauuaaucacaguauuauuuguuguuuguucugagcuacauuuugagcuagggaauuuuuuuuuuuuuuugaccgaauuucacucuugcugcccaggcuggagugcaauggcacgauccuggcucaccacaaccuccggcucccagguucaagcgauucuccugcuucagccucccgaguagcugggauuacaggcaugcacuacuaugccuggcuaauuuuuguauuuuuaguagagacaggguuucaccauguuggccaggcugaucuugaacuccugaccucgggugaucugccugcccuggccucccaaagugcucggauuacaggcaugagccacccugcccagccuuauauuaucucauuuuggccucaccucagugcucagagaccuugaucuacuguuucguuuuauagaugaaaaauuguggcuuuaaaauuuuauguaauuucuccaguuagggaugggucuccagagccuaugauuuuacuauuacccacccaccaucuuguucccuuggacuuuucuuucccuauacuaggcauuguaaagcugcggugugggcaguuuccauccguuuucuauaugugugguuaugggaugaggaucauaauucuuuccuuuuggagaauuaugagccuaccucuuaaaaagaguggguuguacuguuaaccauugguuguucuuucaguuugagcugcugaagcaucagaaacucaaggaccagaauaucuuugucucccgaaccaggcucugccugcacaaucucccaaaggcuguagaugacaaacagcucagaaagcugcugcugagugcuacuaguggagagaaaggggugcgcaucaaggaggugagacguggcccugaccauuuuggagcuuucauucugaucuugggucagaucaagcauuucccucaggcuguggugccagauuuuguuuguuuguuuugagacgaagucucacucuguugcccaggcuguagugcagcggugcaaucuugacucacugcaaccuccuccuccugggcucaagcaguucuccugccucagcccccugaauagcugggacuauaggcgugcgccaccacgccuggcuaauuuuuguauuuuuaguagagaagggauugcaccauguuagccaggcuggucucgaacuccugaccucaagugaucugcccaccucggccucccaaagugcuaggauuacaggcgugagccacugugccgggccaucaacagacuuucuucuggacauguugucagcaugcauagcugaguuuagcaguuucuugguuuuguucuuuuucuucuaagaauugucuuuuacaucugacugaauuacagcagaaugcaaggaaaucucugucugcaugaauuaauuuagcaagcauuuauuaaaugccuguugugugcuuagcauuauacuuugugcuaucaugugaauuuucuugcagagaaaauaaucugcuuugcuuuuuggaagaguauuuuacuccuaguuagauucuuacccuguguucagaguccccuaugccuuguggucaacacaggaagccauguagauguucagcaguugaauuagaaaaacacuggguucacaccaacuugguuagacucugugugaguacagaacuuuucugccuccacauuccccuuugcguauuucucuuuucuuuuuuuucuuuucuuccuuucuuuuuuuuuuuuuagauguggucuugcucugucuuuggcuggagugcaguggcaccaucucgggucacugcaaaccgccaccccccccccccccaagcucaagcaauccucccaccucagccucccaaguaguugggccuauaguuacacaccaccaugccuggcuaauuucuuucuuucuuucuuuuuuuuuuuuuuuuuuuugagacggagucucacucugucguuaagcuggagugcaguggcaugaucucggcucaacgcaaccuccgccucccggguucaagcgauucucuugccucagcuucccgaguagcugggacuacaggcaugcaccaccacgcccagcugauuuuuguauuuuuaguggagacgggguuucaccauguugccaagauggucucgaucucuugaccucaagugauccgccugccucggccucccaaagugcugggauuacaggcgugagccaccucgcccagcccaugcuugacuaauuucuuguuuuugguagagacaggguuuugucauguugcccaggcuggucgcaaauuccugagcucagaugauuccccugcuucggccucccacagugcuggaauuauaacagugaaccacugggccuggccuugcauaucucugucauacugguuacuauuacccuggccucaaacugucugucagucacuucuccccacuagacugaguuuuugaggcaagcguuaucucauuauccccaauccuugguguaguaccugguacauagucaucucuuagucaauauuuauuuuaaaaguaccauugccaauauuuugggccugcuuuacucuguuucgcuaccauaaacuguuuuccuaaucccugaaaaccucuucaaaauguauggauugguauuugggagauuacuugagagaaugugaauauaucagcacauaucugacaccacaguuaguaaaacugcucaguguuacugguuauaggggagggacaguuguguaauuucuccuaucauccgaauacuuagugccuacauauuuaacaccugucauaauuuagagaaauuuauguuuauucuagaauauuuugcauuauguugaauuuuccucuuaauucuuuccuauuuguauguauagugucucaguaagaugguaagcaucuugagaacaggaucuucauuauaugcuucucuugauucccuuacaguguaugacaguucuaggcacagaguggacacuggacauaaacuaaaugcggcauccaugcauccccaauacuuagcuguuuccauuacaugagaacgacagcuuugguaguaauggcauguaaaugaucaguuuucucgaaaaauccuaccauacuuuggugccccagauguuuacuacaucuggcuuaaggauuuaagggaaaaccacacuagagaggaucugagcugcaagcaaagagagcugaaacuucuuccuauauuucugacccuguauguuggagagacuuuuuccuaugcuugaaaugucuuucuuaucuaaagccaucaggccuuccuccuuuccuucuucaauaauuuccuuccugagggcuuuuuucaguuguaagaucuguggacaguacuccauccucggcagcaacuuguuacacgcuuaaaauaccauguaccucucaauuuguauguaucgcaaacaguuguguuuguauuguguuuguuuuuuaacauccauaccgcuuuauaaauuuucuuuaggaaguuuuguuuaugugcuuuuuuuuaggucucuguugaugucuauaagcuaguagaaagcaagaaaauacaauuuuaaucuguuugauggucuuaguagguaaauucuaauaagauggacacacauaaguguuauuccagugugauuuuugugauggugguauaaaugaagauuauguuucaauaaccugauuuuuuuuuuuuuuuuuugagacagggucucacucuguugcccaggcuggagugcaguggugccaucauggcucacuguaacuucaaccuccccgggcucaggugauccuccugcuucagccucuugaguagcugaggugccaccacacuggcuaauuuuuuguauuuuuuguagagacaagguuuugccauguugccuaggcuggucucaaacuccuggccucaagcaauccuccugucucggccucccaaggugcuaggauuacaggcaugaaccaccaugcccacccaauagccugauuucuuauugacucuauuaaagcaguucaugucaggcaagucuucucauucuguaauuacugauuuuuuucuugcucuacucauaguguagagugaugcgagaccucaaaggaguucaugggaacaugaagggucagucccugggcuacgccuuugcggaguuccaagagcacgagcaugcccugaaagcccuccgccucaucaacaacaauccagaaaucuuugggccucugaagguaggccuuguccucuggggagacuuguucccuuaggaccacuugcaggaaaccagccuucuccuuuaugccuaguguccucugacauuugaggggugggaaacaguggcaaguggacaaaaaaaagguggguugggggaggaugugugaaggggaaaaacucagcucauugcaugcacagauuaagaagucuaaugaauggcauucugucucccucugacagagaccaauaguggaguucucuuuagaagaucgaagaaaacuuaaaaugaaggaauuaaggauccagcgcagcuugguacagaaauuaaaugguccauauuuuuaaggacauaaacucuucuauuuuguucaauuugugcuucugcucucuuagaguaguucuccccucaguuagguuuuuuugcuccuaguucccuuuacucccaguucccuaagccucuccaggccaucuucuuaucugcuggcccaugucugauagcucuacagcagaagggaaaggaaggagagaggaagcagaccaauguuauuuccagucagccguuuuuuacaguguuuggugauaguacgugccaaaauuaaugguugagguuaagguuucccauuaccuguagauuucaguuaucucuuccauauuuucuuuuauuaguuggcuccagaagugugaagccugauaguuuuaguacuguuuuuaaucuggugugguauagaagguggagcagggacuuuaggaauacguguacucaugcucauacucuggcucugcccuuuuugcugcauguuccuuggcaguuauuaccgcucugaacuucaguuuguaaaaugggguggacaacaucugccucacaugauugcugaggacuaaaugagauaauacauguccaucgucuagcauacugcauggucagcacgcagucaguacucauucucuuacccaucuucccccaggacauacagggccagauuauucuugacucugucauucuuagagcucucauugauauugcacagcaaaguucccuugcauauacagcaaacauuuguagucuuugugguauauaccaagaggauuaccaacagacgagccauucuggugguuaaugcaguggcccuagguuggaaaaucugggaucugguuauuguucaaggcaacuuuguuccccagauaauagaauuguuuauuacuguuagccauuguuucagaggugauucugaagcuaccaguuuuguuuguuuuucuguuugagauggagucuugcugugucgcucaguuuggagugcaguggcacaaucucaguucacugcaaccuccaccuucuggguucaagugauucucuugccucagccuccugaguagcugggacuacaggugcacaccaccauacccggcuaauuuuuguauuuuuuuaguagagacaggguuucaccauguuggccaggcuggucucgaacuccugacuucaagugauccaccugccucagccucccaaagugcugggauuacaggcgugagucacugagcccagccuaguuuguuuuuuaacauccaaauuacuuuauuuguugccuggauuuauauucauacuguucuuucuguguaaaaaugccucuacucacuuugcauaugcagaucaaaugaucucuuucaaguugcaugccuccaccucucucaaaagauauaaggcccucuuuacuugauuuucaugaacuuccuuaagcuguguaguuuuuuuuacuuugguuuauuugugaaugcaucucuuaucuccaccuggcugugaguccugaaggguagacacuauuuuuuuguauccuggaaacagacuggcacacacuaggcauauaauaaauguucauuguaucguuguaccuaucuagauuucuaaggugaaagggaagaacaacacacacuuaucauuacauuaauuucacuugaaucuucuguuucuuccacuucagugcaaauacuucuauaacuuccuugaugccuuccuucccacagcaucuuuuucuugucgucuuuacuucauuuauuccauuccugauguucuuccuuucuugaaaacgaucaguuucugaccuaugucauuuuucuucucucugaagagauuauuucgcauuucuugcagacaggucuacuggcaacaaauucucuccauuuucuuuugucugaguaagucuuuuccuucacuuuugaaggauaaguuuaucggauacaggauuguagguuggugauuuuuuuuucuuuuaaaaauuuaaauauuaaauaucucacuucacucccuucuugcuuacaugguuucugaagagaagucuuggaaaucucucucaaucuacucugguuugggagggugccuauuaaaaacaaaagagagagagauuugauguaaucucauccuuguuccucuauagguaaaauuuuuccccugucuggcuucuuucaagauuuuaucuuugauuuucugcaguuugucuaugauaugacugguuguaaauuguuuaguauuuaucuuauuuggucuucucugaguuccuagaucugugguuuagugacugucauuaguuuugaaaaauucucagcccuuauuacuucauuaucuuuucuguugcuugcuuucuucuuguauucuccuucuacauagguuacaccuuugauaauugucccaccuacugacuuuugaauuuugggcaugcacucucccuuauuucuguguuaugggaaggggaaugguuauuuugugccccccacccaguaaccaucuguuacuguggcagggcuugugaucuacauguauucacuuuccucuagucuccaauugugugggggaagaauuccucuucuuucaucuagcucacauaaagcucaucuucugcugaguauuugcagcaaacaaagcucauccagaaaccagauggcauuuucuuguuuuaugcagcaaaaaaugagauccaagccugcaacuggugagccucagaaggggcaaccagagccugcaaaagaccagcaacagaaggcagcucaacaccacacagaggaacaaagcaaggugcccccagagcagaagagaaaggcgggcucuaccucauggaccggguuccagaccaaggcugaaguggagcagguggagcugccugauggaaagaagagaagaaagguccuggcgcuccccucacaccgaggccccaaaaucaggugagaugcaggagggcagaagcacagaacaguggguggguucuaagcggguuuguuuuugcugaguuauuuucucuuuguggcauuuguuugguugaaaaggauguuuggugcuauguauucccacacaugggguuaacacgcgagucuucaacaccaucagagaugucacucuuagaucaauggcagaggggccuccuagggcaggcuuuugugccccuuuucuccucuuuugaagagcuuccucuuguccagauggccaucucugccagcugagaccacauacuugagguucaguuguaguuucuguuugggacagcagauuagugcucuacaaaaguaaaucuuuacaaaauauuuguuaaauaaaugaagguuuuugagauauccaugggguuuuauuuauuuauuuauuuuauuuuuagagacaguguauuauucaguucuuccacugcuauaaagaaauaccugagacuggguaauuuauaaagaaaagaggcuuggcugggcgcgguggcucacgccuguaaucccagcacuuugggaggccgaggcggguggaucacgaggucaggagaucgagaccauccugguuaacaugcugaaaccccgucucuacuaaaaauacaaaaaauuagcugggugcgguggcgggcgccuguagucccagcuacuggggaggcugaggcaggagaauggcgugaacccgggaggcggagcuugcagugagccgagaucacgccacugcacucuggccugggcgaaagagcgagacuccgucucaaaaaaaaaaaagaaaagaaaagaggcuuaauuggcucaugguuccacaggcuguacaggaagcaugacagcagcugcucaucuucuagggaggccucaggaaacuuaaucauaguggaaggugaagugggagcuggcacaucacauggccaggagcaggggggaguguuuuaaacaaccagaucuugugguaacucauucaccgucacgagaacagcacugaggggauggcgcuaaaccauucaugaaggagucauccccaugauccagucaccucccaccaggcccagccuucaacacuggggauuacaauucaacgugagauuugagcaaggacacagauccaaaccaugucacagggucuugcucuguugcccaggcuagagugcaguggcaugaucauagcgcacuguaaccucaacuccuggacucaauccaccuuccucagccuccugaguagcugggacuuuuuaauuucguuguaguagagacgggggauugcuauguugcauaggcuggucucaaacuccuggcaucaagcaguccuaaguauacaaauguugagcuuucagagggucuguugcaguaucccuuuuuagaaugacuucacuuaucaugggcuugggaagggccaguguacaaagagaaccuaggggugucaaauuagaagaaggacucaaggugacacucagccauguuauuucagguugcgggacaaaggcaaagugaagcccguccaucccaaaaagccaaagccacagauaaaccaguggaagcaggagaagcagcaauuaucguccgagcaggugaguucugcaggacauacagcuuugguauggcaugguucugccaggucguagccauguuuguaccuugguuaguugagcaaaaaagaaaaaaagaaagacuucuguguaggacgguagcuuuuuagagaauguugagcuauacaaucuuaaaaguggagagaaaaaaguaaaaugaaccuccacguaucuguuccuguguuucagcagucuccuuguuuuacauauuccccauaacaugcuuuccccacuagaguauauuaaagcaaagcccauuucacauguaaaugcgucucauaugaaaaugaaacauauugcucagaaaaaccucagagugcaucucuaacugaucaggccuuaaacacacacaccuuaugccauuauaauaucuaaugaaacuaauaagcccuuuaucaucuacuacacaaaugauauauuaaauccauauuaaaauuugccaaauugccugaaaaaaauuuuuuuauacuugguuaguaugagucgggauccaaagucccacauuauacuuggguuuuuaauuucuuaaaucauuuuuuucuucucuaauauccauucucccuuaccacccuuuuuuccaugcuauucauuuauuggagaaaccaggucauuuguguuacauuuuuaauuuagccauuugcuucuuuguggugucauuuaacuugucucugugacacccccauauugccugucaucugguaguuaguucggucugguagcuugaucaaguucaguuuucuuuuuuuaaaaauuuuuuugagguggaguuuugcucuuguugccuaggcuggagugcaauggcgcaaucucggcucacugcaaccuccgccuccaggaguagccucccgaguagcuggaauuacaggcaugcgccaccaugcccagcuaauuuuguauuuuaguagagacgggguuucaccauguugaccaggcuggccuugaacucuugaccucaggugauucgccugccucggccucccaaagugcugggauuacaggugugagccaccgugcuuggccucaaguucaguuuucuugaagagaguauuucauaggugguguguguguuuccuuauaucgccugaggcacauacuaccugguugcccauuuuuagugauucugggauugaucaguagauuugaggauuaucugccuuaucccuccauugaugaaguucccaauuagccuuucauguaauggccuuagcaguuauugaugaguguuaccagauccauuauuucauuauggguuacagaaugcugauuauuuaaacuucuauccuuuugcauuuuuaauuagaacccuagaaagaaaaaucuuccuuugucaauuauuugcuuaccacaaaauaucauuuauguaggaaagacaggauaaaugcuugauuuuuuuuuucucucucucuguuaguuuucagaguaaugagcuguugccauacuggcucauuuuuuaguauuaugaaauccugaguuuucauaugcuugauguguuucaaauacugucauuauucuuacucuguguaaggcuggcagaagccccugcagguuggcuucugagucuuucugauguggcguauuugucugguaguauccuugcuuucuagugcaggaugucccaggcucagcucagguaccucuuccccaguccugacauuagccauuuucccaaggagccuuaguuccuuuuaguagaaaacggugguccuacauucuugaacacuugaagucaagcuugcuucuccccuucccuagucucuuuccuuuaaggguaaaagcagcauuagcuucccauccuacucaagaaaucugugucugggaaguuucugacguauaccguacuauaguauagagaucucugaaaucccaugagcaguguucuuggggagggaacaggcaagcaagaauggccggacucugugcugacucaucugcuuugaggcuaaagugagccuuugggagcuagaguaagagaggccccugaguccccagcagacagggagguuagucaggcccugcucccugugcacucacucuuggucuaauuucuuaccaguggaugauucuguuugagccuuucucucuaagagucucucucuagaaaccuaccccuuucugguagauaugaucucugucccacuuacuuucucucuuggguggccugaggguaaggugauauauagucuuugaaauugauuauauuauguuucuaauccuuucauuuguagguaucuaggaaaaaagcuaagggaaauaagacggaaacccgcuucaaccagcuggucgaacaauauaagcagaaauuauugggaccuucuaaaggagcaccucuugcaaagaggagcaaaugguuugauaguugaugauggcagcaggcuggguaagaagcuggguuguguacuuucuggugacacuccugggcuccuccccaucccccgugucucucacugagggaaagaaaauccccaagggcacugccacugugcucggaggugcccuggacuguguacaucugaacuuugguccauccuuugaugugugguucguuagccacaaagagaaauaucugaaagucaacaugaugcuucuugcauauuauccagauuauuguaugaaguugugucuauaauuauuaccaauuuuuauucuuuauuucucaaauggaaacaccugaaaaagcauucuggagugcugaauuuuuaagauguauauuuuguuaagcauauucucuaaaugagauauuguguggcuuuuuaguaacaacgucauuucuaaua

SEQ ID NO: 191589 - RNA, 3302 nt, Homo sapiens
augagaaaaaugucggaggaagaguuuuaucuguucaaaaauaucucuucaguggggccgugggaugggccucaguaccacauugccccugucugggccuucuaccuccaggcagcuuucaugggcacugucuuccuuauaggguucccacucaaugccauggugcugguggccacacugcgcuacaaaaaguugcggcagccccucaacuacauucuggucaacguguccuucggaggcuuccuccucugcaucuucucugucuucccugucuucgucgccagcuguaacggauacuucgucuucggucgccauguuugugcuuuggagggcuuccugggcacuguagcagguacugcaggggaaaaagggguuaggggaaggcaaagguugcuacuccacuggaggggguuccuaaagaggagucugggggaaaugagucuggugcuuuuuaaaauacugggguacaaagcaacccagacuagaaguuuggcuaaaauaggauguuugagucuucacuccaaaugucaguccagcccugucucucugugcuugcuccacccgaucuguuugccacucugccagccaggcuggguggggcucugucuagcccauuauccucacauuucaccacaggucugguuacaggauggucacuggccuuccuggccuuugagcgcuacauugucaucuguaagcccuucggcaacuuccgcuucagcuccaagcaugcacugacggugguccuggcuaccuggaccauugguauuggcgucuccaucccacccuucuuuggcuggagccggugagagugcagggcaguggugcugaguuaacuaggagcucagguugauguggguggaaagagagcuuggguauaacuauuuagucuuugaccucuacuuuuaaagaguugcaauaugaggcgaaagggcagugggagacaagugcuaacguuuacucugcaguuggaauugcuguagcuucucccagucaggacagaaaaccccccugcuugaagccuuagggcauuccguggguucuaaguggagaacacaauccaggcaucucagcucccacugcacucuuguggagaguccagugagcaaguguuugguccuuugcagguucaucccugagggccugcaguguuccuguggcccugacugguacaccgugggcaccaaauaccgcagcgaguccuauacgugguuccucuucaucuucugcuucauugugccucucucccucaucugcuucuccuacacucagcugcugagggcccugaaagcugugaguggcauuugauagucagggaagaagggguucggggcuccacaugagaaggaagagugcucugaaacauaagaugccuggaaauguccauagccagagaggguaucuaaaagcagcaaaggaaguaggaggagggagaaugauggagauccaaaggaacuaggccaggagaugggacagaaaagaggcaaucagaguggaugcccccucccccaucccacagaaaagcauccagagaccgggcgcaguggcucacgccuauaaucccagcacuuugggaggccgaagcagacggaucaccugaggucaauaguuccagaccagccuggccuacauggcaaaaugcuaaaaugcgaaaauuagcugggcaugguggugugugcuuguaaccccagcuacucaggaggcugagacaaaagaaucacuugaacccgggagguggagguucagugagccgagacugcaccacugcaacuccagccugggcaacagagcgagacucggucucaaaaagaaaauuaaaaauuaaaaauuaaaaaaaaaaaaaaaaagcauccagagggccaggaaaaagagagaugugaugcuuuccgugcuccaccccagguugcagcucagcagcaggagucagcuacgacccagaaggcugaacgggaggugagccgcauggugguugugaugguaggauccuucugugucugcuacgugcccuacgcggccuucgccauguacauggucaacaaccguaaccaugggcuggacuuacggcuugucaccauuccuucauucuucuccaagagugcuugcaucuacaaucccaucaucuacugcuucaugaauaagcagguaaagcucuuuauucacauuccuaugguccagaagacccugguucuuuucucaccauugacuuuuaacucagagcacccuggacucuacccagguuucuaguagacgagggaagccacaaaacccccgaguagguugggaagccuuugguaagcacagggaggaaggcacgguuaucaagacgagaaaauagaaccccggaggaaagaacuugagucaggaaaaugaaguugcuccaaagaacaggaugaaugaaagcauuuuauugaaaaacucgugcagcaaaccaccauggcacacguuuaccuauguaacaaaccugcacauccugcacauguauccuggaacuuaaauaaaauuaaaaaaauaaaaauaaaaacucagauuccucucaauuuucaguccuugcauuuaauaauuucuuaaucauuucccuuccaacuuuuagccugcacgagcaugugugaagcacagaaaucauaccacaugcaaaaaucucuaaaauaucuuaucaucugaagguacugggggauuuccuaucccaucugaaauccgagcuaauaaacaccaaacccuaaguggcaaaaacccuacuuucagaugguauuguuuccucaaucccagagguagacucaaaacuaauuugaaaccucccuggauagaagagaauuggcaguccuuuccagcugggagcaccugcuaguaauggaggggccucugcugacagugcuuuuaugaagcaggaugguuugugaauuuaccaacagugaggucucagacuugaccaguuuaggauuaccguagacccaggaguaguucuagacuggaaucuagauaguuuucaggauggggaagauagauucaaaaccaccuaagggcauucuggguacaaagcauugugcaaggcuuuggugauacagagaauaaggucuuuuuucccauacuuccucaucugccaagguuaucuccaauuguaccuuucucuccaguuccaagcuugcaucaugaagauggugugugggaaggccaugacagaugaauccgacacaugcagcucccagaaaacagaaguuucuacugucucgucuacccaaguuggccccaacugaggacccaauauuggccuguuugcaacagcuagaauuaaauuuuacuuuuaa

SEQ ID NO: 191590 - RNA, 127004 nt, Homo sapiens
uuccugguccagaacuuuacacagaaaaggugcucaaaggauauuuguuuaaugaaugugguaugcugacauuuaaacaggacaaaacuuggugaguaaaauuaauguaggcagucucccauccauucaggcagcuuuuccauagacguuugugagaauagagugaacaaauggaauguggaugauauacacuugguaaaugcaaaugaugaaauaaaagaacaaaauauaaggugauaguacuuacagagcuaacagucugagccuugccuggguccuauuaaugagucuucuacuuucugugucuuuaaauuuguaauggucucuuagagagaggguccucaacuaggauggaucugaucugaaaagcaaacauucaauuuaaauuucaauaguucucugcuugugcuugaucuaguaaugucuuuucaaaagggauuauagaaggugaauguuaaaacaaaucauuuugauuuuccauagugaguuaagaaauacauuuuguuguuccucuucugcuuucuaaguaauauguugggcuucuuucuuguuuugucguugugaggcauaguccgaggaaaccuuuguuuucuauaaauccugauauucuuuggauuggaagaggcaguuuccugaauaagaaagagucugacuacacuggguaaauugucagauuauuuuguccucacagaaguuaaaguguaaaauugggugagggcauugcuuugaaagaguauuuuuauuuauucuuuuaaagaaaguagauuaauaaaaagauugaucaguucaaauaccuggaauauuuaaaccaguuuuauguuaaccuaaaaaaauuauuuuguaggcauuucgaaguuugaccuccuuuuuguccuaaauugauuuuaaaucaguaucaaaugcugaggaccaguaaaugaaacacucauauguuguuuugagcaaaauuuuuuauauuaugaaaauauuauaacuuugaaguugauacuuaaaauacuugagccaaaguuucugccuuuaugugggacauuuucaugagcuuucuuauaucaguuugcuuacuuacuuuucauagaguugagcgagacuauagcaagagacccagggacaucuuaacauccuugaauauuucugaaucuuucuaaggaauuugauuuaauuuuuuuuuuuuuuugagacagggucuugauuuguuacccugaugugaucacugcucacuguagccuugaucucccugacucaagcaguccuuccaccugagccuccugaauagcugggaucacaagcgugcgccaccaugccuuccuucuuuuuaauuuuuuuguagagauggggucucccuauguugccaaggcugguuuuaaauuuuuucuagaaacgaggucucgcuauauugcccaggcuggucuuaaauuccuagcucaaucaguucucccaccuuggccuccuaaaguguugggauuauaggugugagccauggaggcuggccaggaacuugauuuucagggagaagccuauucaguguuuccuuggacuuccucagccugguuuuaucauagcauauuauaagaugauaaacugaaaccaucugauuugaaaucaccaaccugggaaauaccagucagaaauuaauucuauuuuuaugacauucuuaaaagacuguuuaaaacugaccaaaguaaaaaaucuucuuuuagaguuauaaguguguaaaaaaaggcauauucaaaauaauguauauauuuaaguuuacuggacagauuuaaauuuguguucuuuguguaaggcauagauuggaauguuugcuacagguauuuuuuggaacacggauuucagauugcuguuugcuuauaaauaugcaugacugcugaccuucagaacugcuuuaaauuucucaaaaaauuuucucauuauaugccaggcuuaguggcuugugucuguaaucccagcuacuugggaggcuaagucaggaggacugcuugaggccaguaguucgagaccagacugggcaacauaauaagacugcaucucuaaaaaaauuuuaaaaauuagcugagcguggguaaugugcacguagucccagcugcuugggagguugaggcugaaggauugcuugagccuaggaguuugaggcuacagugaggugugaucaugccacugcacuccagccuggaugacaaagggagacccugucucuuaaaagaauuuucuuauuauaauagauacauuuaucucugauuuacucaguacuauaaccccauuuaaguaguuugaagagauuaggguuaaguccuacuguuuuuaguaugacuacaguaguugccacuuuaaacaauuuuugaaauacuuuaggcauaaaaaaggauauagaacaauauaauaaauuccauauaccuacuaccuaaaguaauaaaaaucacaguuauuguugaagcuuauugggcaccccuuccccauccuaguccucucccuucccagcugugaccauuauucucaauuugauauuuauucucucccugcauuuuuacaaacuuuuucuguauauauauauguauccacugaaaaaaaaaacaauguuuggauugcagggaaaacuaaaaaguguaauauuguuuuauauguuuuuaagcuuuguauaagagguuaaacuuuauugguacauguaguuauaguuuacucacuuuaaaugcuguagauauuugauauaauggagugugaaaguaauacauguuuuuuguagggaauuuuaaaaauaaagggaaguaugaagaugauaaaaauuuguagcccagcuauccagagauacuacagucaauauuuugguuuuuuccuuugcuucuugucuucccacuuauguauguauuuuuugguacccuuuaauauaaaagggacccaguuuuaaggauuacauaaaauugcaaaacagcuacauaaagccuguaaucccauuuuaauugauucuuaguugaaaagggggaaagaaaaugaaugagcauuauauaucagacauacuugguaaauuuacuaccuauaccagauauugauagucuauuucuuaauaugcaaacaccauagaaguggcaucuggaaagaggcuguauuacugaacaugcuuuuaaauuuauaugagauuuuucuaguaaacaaauuuuccagauaggugaugcuuaucuuuuuaaacguuaaauacuguuuugguuuuaaccauuuuuuaugggaaaaaggaaaauaaaaagccuacaaguauuucugugcucauuaagccagaauacuguggugugcuuauaauuuuaucuuuucuuggcaacuugaugucacuguggaaagcacugauuacugaacuguguugugacuucuuuuguucuaggugccuuugaacccuugugcacuuuuuaguuagaucuuuauuaacaugcuaugccacugcagggagggagcaggaaaagcaugauacacaauuuaagacaagugccaccauaggcuacuguuggcaaacaagagcuccaccaaacuuuuuaaagugaagaagcaacagucugagccauuuuucucaccaguggcaggagggggagacuuccaccagcaacauggaaucuucaguggaugcagcugaccaacccuccugacuucucagucuuuucccaccacugcucacccuuuauguucagauguauucagcacuagauaaccauacuuauuaacuauaagugauguguguguguguguauguguauauauauauaaaacuguacuuuaagaauaaauauauauaaacuauauguguaacaaauuuauaauauauaaacuauaaaucugugaaaguauucagcauuauauaacggcaggcuguggugauuuagauugguggagcuccugaccaugccugaaaaucccuguaccccacuuugaccgugauuuuuuaagggaauauuguuuuuuuacaucuguauuuaaaaaaaaaaaaagauauauauauauauauauacacacacacacacacacacacacuuuauuuuuuagagcaguuuuagcuuuacagaaaaauugaguggagaguauggagaguuaccauauucucuccuacccauuuccuuuauuaauaucuugcuguugugugguagauuuguuacaguugaugaaccaauauuaacagaaguccauaguuuacauucaaguucauucuguguguuugugcagucuguggauuuugacaaauauauaaucauucagaaugguuucacuaauccagaagucuccuggugcuccugucuucccuccuuucucuaaccccugacaacuauuuuuuuuuacugucuccauaguuuugccuuuuccaaaaauguccuaugguuggaaucauacaaauguagccuuuucagauuggcuucugucacuaagcaauauguauuuaauggcuugauaacuuuucauggcuugauaacucauuucuuuuuaaugcugaauaauauuucacuguauggauguaccacaaguuguuuaucauucacauacugaguaacaucuugguuguguucaaguuuuagcaauugugaauaaaacugcugugaauauuuauuugugugcugguuuuuguguggacauaaguuucagcauauuugaguaaauaccaaggagugcaguuguuggauccuaugguaagacuauguuuaguuuuguaagaaauugccaaacaggcuuccaaaguggcugauguauauauuuucagguugcucguguguuuuucaaaaacaccuuacucagguauauugauggacugcuugcccugugauaggauuacaaguaauugaggucuguggggcugguugucccuacauaaauaauaccagcugguuguacuucgcuuguucuuguuugcuuucucuuuucuuuaucuauuuuuuuccuuuuccauguguuuuuacucucuuuaucuugcuuuaccaguucugcuuuguccucagaaaucagaggacugcauuuguuggaauaguguauaaauuuaaaaggcaaaauaaaacaaguccaaguccuuucucagggucucuaggcgguuggggaugguugagauuguagcauuaaguaagguauuguuggagcauuaauuugacuauauagaauauaaucuucagagaugggaaaagggaaacaauacguuaauaaaacuugcuuuccuuuguaauuuguuaauuauagggcaacuguauaaaauguuuuaagacuaugauagcagaagaguuuugguuuuuuuccuaccuuucucugggagagcuuuucagcuucuacuguuacaguuuuuguuuguuuguuuguuuuuuaagcacaccaccuuugggaguguuacaguucuuuaaagaggaccgagccuuugcuuaaggcuagcuucauacuguuuguauaauucuguuuguaugugcauuuguacauacccccagcugcagcagaauaucaauagauucuguucucccaggagaagggcaaggacuguauccaaucuuaucugggguauguauccaaaugaccuaagacagucuuccuaauaaacacuuuuggaccgcaggguucagacucuccugggguggaaucuuuuuuuguuaccuuucuuucugccugcucguuuaagucaggaugcaugcaaggcccacgucuccagugcccccaagugguugucuagguuuugcaagaggacaucuagugaugggagaacucacugcuuccagccacucugucuauacaccccguuagaaaaaugaucuguugaccagaauuuugccauaauuuccuaccuuuuuuuuuuauuagggucacagacuuaaucuaauuccucuuccucauaauggucuuuuaauauuuuaugagagagauuccuaaaguccuucuuuagauuuaaacaccucuuauuuuucuaacuauucauuaauuaagcauuuucauagucccagugaaauguaacgggcuuuuucucguaucuuuaaaaguggagugcccagggcuaaguacaggaguggucuuuguucacauugugcauauguugcuugucaugugauacuuuuuuuuccagacuaaauuuacugugagccaguguuucugaaucuuuuuacuuucucugugaugaugacacaagucuccaucauccuguuuuuguucaauggauuguggguuuuuuuccuuuuuuuucaaaacagagucucacuguguugcccaggcuggaguacaguggugugaucucggcucacugcaaccuccaucuccuggguucaagcgauucuugugucucagccucucaaauagcugggauuacaggugugugccccacacccgacuaauuuuuguauuuuuaguagagauggggucucaccauguuggccaggcuggucucaaacuccugaccucaaacugcugaccucaggugaucugccuaccuuggccucccaaagugcugggauuacaggcgucagccacugcaccuggcuuuucaauggguuuuuuuagaacaaaguuuagaaugauauguuuaugccugugaacauuuaucuuguuagauuaugcucacuaagccauugggguguuuggggaauuugaucaauguaucuuuucugucucuuuucaguuucgaaaacuaucccucugcugcugcuuuucuuccacuugucuuuucucaauagcugauucuaguuuguguugcuucgauagauacguauggcuaaacauaaaccuuagacaauagaaaaacguauucauuugcaaagcugccaggguguuuggagugcuugaaucauauugaacuucaagaaccauuauguuucuuugucuuuuugacaguuauuggagccaauuuguguguuuucaguuucucuuaaacuuucaguauguauuugaaaagcuugcaggccccaguuacugugucuauaaugccuaguaaguaaaaugacccacagaccagucaauaagacagggcuuaacaggagaguaauccuugguccucaguuucccaacuguacagugaaauacuuggauuaaucaccauguuuccacuugugcucuggaguucugaguggugaggaggaugaauggcuuuaacucucugcauucccauacccuucaauagaagaaauuccacuguuaccuuacauuuugagguucuguacaggauucugcuuaaagaaaaggcucugcugaaaaaaaaaaaaaagaagaagaagauucauuggaaaccccugcaaaaaagcaaggaagaaaauggcucccagaggacacugggcagcuuggaaagucuguaugugucccugauuucaugaguuuggaggccucugguauuucauuugguaaaaagaagaagagcuuaugcuguuugucuuuucuuucucaaaccuggacauaacaaugguuauaaaaguaaucacagucuuauuauuuugaagggagaaauaaaucuauaaagcagaaauaaaguuuuuauaauccauaauucuauuuugcauagauaaaaaguauucuuaauaguuuuaguauaucuuuugaaauuauuuuguuuguccacaaccauauuuauuuacacuuaaaaaaaugagaccacacucauucuagcagauuuuauaaccuguuguuuucaauuuccaucauuuuauggauuuuuuugugugucaauacacauaaaucuauuucauccuuuaagacaagcuuauccaacccgcagcccacaagcugcaugcggcccaggaugccuuugaauguagcccaacacaaauucauaaacuuucuuaaaacauuaugagauuuuuuugugauuuuauuuuuuguuuuuuuuuuucuaagcucaucagcuaucguuaguguuaguguauuuuauguguggcccaagacaauucuuccaacguggccuggggaagccagaagauuggacaccucugcuuuaaggcuucugugauauuucucuguaccaagaguuaauauuccuuguugcacagcacauggagucuauucuaaaguagacucuaguuuuuuuuguacauugcuacuggcacaguuuuuuuuuuuucaauaguucacucuuuuuggggguugugauaugugguguuuuuuucugguugcuuccuuuuccucugguuugacuacagaucaagaccuguguuaucccagucaagcuacagauacagauugcccuuuucuuucagacaauagcucuaauuuaauguccccuuucauaguuacaagucuguucuucagaacaaaaucuuggcagccagaauuauacuugacacuuuauuccagcauauuacugcuggcgagaaagacgguugacuuguuuugacccaagugagcuuaguucuaagagacuaggaagguggaugaugagcagcuuuuggugguuugacagccagcugcaggacauccauuguggccaggaccgaguagcugcugauaaauguggguaugguaaauuacauuugauggccucuuuuccccuucuguuuuugagaauuuuaucaaagauuacacugagaaagugguauugagaaaaauauuuuuuauucuuaugggauaauuauucucuucucuagccuauacuucuuguaaauggcaacauugguaguagucauggaaaaauuuuggugauugguuuuuuuaaacaggaaauauaguguaaauguuauuuagguaguuuugauuucuuuaggaacuuagguagcauuucuccccuccuucugugaguuuagugauaucuuuuauagacuuaaauucuaaaauggagauguuaugccuaguuuuagguaaaggcauuuuaauuuuauguucaauuacuuucuaaauuuugcuuuagucuugaaauauaauaugcuuuuuuacuuuaacauccuuguguaggauucuaauuugauuuuuuuuccuucuuacuacugugccucuaauuuugauuauauggcaucuuuaauuuucuaaguaauucaagauacaguuuaucucaaugaauuaacucacaaaguaaauaugggaauuuuuuuugggacagguucucacucugucccccaggcugcagugcagugacacagucucugcuuacugcagccucgaccuccauggcuuuacugauccucccuucucagccucccgaguagcugggauuauaggcgugcgccaccaugccuggcuaauuauuguguuuuuaguagagaugggguuucacuauuuuggccaggcugcucucaaacuccugacaauuuauggggauuuugguuauuugaucuugacucuuccauauauacuugauuuccaguaauuggcgugguuccaguuuuacauuuuguuguuuccuuguuccuaaauuuauauaaauaauaauuuguacagauuuucauaccuuuuaaaauucaacuuaaaauaauuuuuauaaauugguuuaauacaaacauagaaauggugugcccaacucuccauuuuccuuaaaaagucagccccuuguccccacaacccuuuuuuuuuuuuuuuugcgagauggagucuugcucugucgcccaggcugcagugcaguggcaugaucucagggcucacugcaaccuccaccuccuggguucaagccauucuccugccucagccucccgaguagcugggauuauaggugcaugccaccacacccagcuaauuuuugugucuuuaguagaaacaggguuucaccaugcuggccaggcuggucucgaacuccuggccucaggugauccgccugccucagccucccaaagugcugggauuacaggcgugagccacugcgcucuuccgcccccccuuuuuuaaaaaaaguaauauuuuucucuuuccaucuacugaaaaugggaauggauaguuagcuaaacaauuuaauauaggugaagaagaacauaaagucaguugaacacucuggcgcucacagaauacuguagcuucacaagacugcuuuggcaacuuuauaaacugcauuuauuccuguggcugagaaucaugcugucagaccucucaguuugugggaaucaacucucaaaguagcuauuguauauuaucuaaggcagugauggugggguugaggguugagggagcaggagauguauuagagggaccaggauggguggcugcagguacaauuugaaaaaucaauucaacacacauaccguuuuauaauacaaauucacggcugggugcugugguucaugccuguaauccaaguacuuuaggaggccaagguaggaggaucgcaugagcccaggaguuuaagaccagccuggcaacauagugagaccuggucccuacaaaaaaauuuuuuuaauuagcugggcgugguggcucccgucuguagucccagcuacucuggaggcugaggcaggagggucccaggaggucaaggcugcagugagccaugauugcaccacugcacuccagccuaggugauugagugagacccugucucuuaaaagacaaaacccaaauuuaccguacccccaguaaaacccaaauuuuggcuugaagauuaauuaauuaauagcuuaauuauuaagcuauuaauacauaauagcuugcauuagcaguuaaggagcccaagcaaauaaugaguggagacugugcucggguacaaagggugggacucugauggagcagcuggaacacuugauugagaagcaggagauagggguucaaguuuuggauuugccaccaauuagagaugugacuuuggguaacucacugggucuuucuuggucacaauuuggaaaaugagaacaucaaacuagucuccaaagucuuaagcauuuuagguuugccucugguuaaaggaaugcucuguggacaguuggauuugaccaguuaucaagguaagauuauaucuuugggaaccaaaguaaacaguuccagauuuuucagccagucuucaucaggguguuauuuguacauccuaacaaaucacagagccguggagaccuuaugaugaauaaccauaagccuccuggcucuucccuuuucuugccaucccaguccuacuauccagagacagccuuuaaaaacuuuuucacuauuucuguuuuuagcuucacuugugguuacuuccauaagccuuaauaauguguuuagacuucuguuccuugauuuaucaacuuuagaugauaccugugaaguuuuugaugugaaaaaugagaauuuaacucacuuuuuuaccccugucauuauuugauauuuauauuacuuugaaagucauuuauuaauuaucuuuauaauuuuaaaugauaaacuuuaauuuuuugauccaucaacuuccuguagggccucuuaacuugccauuuuggaaaaugggauuguaaauacccccuucacgucccucuuuuuauauucuaccuucugauaccuguacucaacuugcauauugucuagguuauaaaagguuaauauuuuuauucugucuuccauucaccaccaaguauugugugcuuuccuuuauauuuagauugcuguuuuuauugcauucgcuuucucugccugcugugaacauaugcagaaucauaaguguacgauuacucaaaauguuuaugucuuuuaaaagcuaaggaaauaauuugguaugugcuuaaagacucagcuuauuuuauuuuuauuuauuuauuuuuuugaaauggaaucucgcuuugucacccaggcuggagugcaguggugugaucucggcucucugcaacuuccacaucccggguucaagcgauucuacugccucagccucccgaguaguugggacuacaggugcgugccaccacgcccagcuaauuuuuuguauuuuuaguagagauggaguuucaccauguuagccaggauggucucgaucuccugaccuugugauccacccgccucagccucccaaagugcugagauuacaggugugagccaccgcacccagccuagcuuauuuuauuuuuugagacagagccucauucuguugccuaggcuggagugcaguggcacaaccucggcucacugcaaccuccgccucccagguuccagcaauucuccugccucagccucccuaguagcugggauuacaggcacucgccaccaugcccagcuaauuuuuuguauuuuuuuuuaguagagacaggguuucacccaguuggccaggcuggucuugaacuccugaccucaaguuauaugcccgccucagccucccaaagugcugugauuacagacgugagccaccgcgcccagccaagacucagcuuauuaaaccauuuauuuacucauuauucaagagauauuuauugaauacuaguuaucauuaacagugcuauuuauaauagugagaaauuggaaauaaccuaaaugacuucagaggauugguaaacuaaacuacuguauguucuuacagggaaugcucuguagacauuuaaaaaagauacaaaaauguuaauaacauggaauauuuuaaucuauauuaagugaaaaaauauuuguaauacaguauauacaauauaggcucauuuuuguuuaaaaacaaugaaacaaaaccaacuguauaagaaacuagcaggggaaaugcuggaagcauauacauaaaauaguuaacuugguaauguagcuaucucagguuacagugauuuguguuuauuuuuaauuccccuauauuuucucaguuacccccaaagaacacaagucacuucuaaaagaauacauucuuuaaaaaauuuuuuuuuuuuuuuuuuuaaaugagauagggucccauuguuuuccaggcuggaguacaguggugcaaucucaagucacugcaacuucugccuccugggcucacuccauccucccaccuuagccucccaaguagcugggacuacaggcaugcacuaccacacgcagcugguuuuuguauuuuuaguagagaugggguuucaccauuucacccaggcugagaauacacuuuuuaaacuuagagauacaaaauuagaauugccagucauagguuuucuuggaauacacaugcuacaauaauguaggaguaccugauaagaauucaguaaauauuuguugaaugaaggagagaaugauugaauagcagagauuccuaggucugugguauuggcacuuaaauacuuucauaauuuuauccagaaacaauccuuaguucaguuauuucagaagaaaaaucaugaauugagcuguccugcagaagcuaggaaauagcuuuaacuggcuguugguuguguagugacagauccagcagaauugagcccgccacugaagcagccaggcaacaaugcuguuucacaguaugcaggaucugaauaaaaguguccuuugugcuuauuugagacuggggggcgggacuuguggcaauuuacguuauuuuuccauaauggaaauugaggcagccucuaauccugcuaucacacauggcaacuacuuauuugauuuuugguaauuugggagcagcuguggacaaacaauuauucugcaaaaagagccaugccagcugcauucugacccaguugcaaaugcuuggguagaccaaacuuccuauucaccaucuuucuaaaccagggauagcuuuaacaacucaccugcuuuuuauugauauguguagcuucugguaagcgucuacauauuugagaaugcacucucuaaugcuuuuuuauuguugucaccaaccuucacuaggcaccuacuucauucaggcagugugccagacacaggguuguaagcuacaagauguuauacaguguggauagacugcuuucauuuugacaggugggucagcauuagcuuuauuuuuaguagacuaaauggcaguguaaagaaagaaucugguguggaggcaguugggagcuguguuccuuugguccccagacucccccugaaucugcugucugcgcguucauugauguccccuugcuaugccaugugcuuucacaagccguugcugcugccugcagugcccuuuuuuucauucuggagccugacgagcuucugacuguagacucugucauuuccuucaggaugccugccccauguccuugcaguuuugucuucucugugcucccuuaacccuuagcaaauaucacuagaauaggauuuguuuuuuaaauggcgaaagccuacuuacuuaacuguauuaauucagucuuucaguauacacuuauuuauuuuuuaagcucuuauaacccaggggcuuagagagauguuucaguaaagaaacauaggaaauuagguagguagggucaucuauaaugaguaaaaagacagcguacuuuugacugugaacgucuguagggcaaggacaaaacgcugacaaucuuuauuucugucucuauagugcugaauuaucacaagggacaaauggccugaauaauuguaugaacccacucuauuagaaauuaccuucacacugauagauaauggccugugauaagaagcaagucaaaacuuuuuagaauguagaacugcacuguucaauauaguagccacaagccacauauggccauuuaauauuaauuaaaauuaaacauuuaauuccuuaugaucucauguggucaguaguccacauguccagcuacaguuuuggacagcacacauuuagaauauuuccaucauugcagaaaguucuaccagacagugcuaauccagaaccuauaagagaguugacauauuuuaagcauuugaugaaguacauugacuuaacucuucucuauggaaagauguuccggcaagccaaaauuccccaugcugucuuuacauuuuuuccuuugcuuguggcacccucuaguguucuaguaauacauagucuauuuauaauuugaauagaagaagauuggaauauuuuggagaauucuguauguguagcauuuuucuagggaggagcucuguagcuuucacccauccccaagaaaguuuaugauucaaaaacgauuaagaacucuaugauagagguauuuguauggucaaaauuccuaaugugaucuguaaacauuauuucacccaguguaaaaaaaaaaaaaaaaaucauguaacugucccuucaacauuucuuugcuguccucaucuuuguacauggaauaagaauaaguuacacuuauauagcacucacuauauaccauguccccuuaagcccuuuuucaaauaguaauucauuuuguccccaguaauucuaugaaguagauucuguuauuuuccuucauuugacagauguuacaacuaagacagaaaaagucaaaugaaacuucuccaaguugcuaguaaguggcagagcaagaaauggaauacaguauucugguuccagaguuuguaccaccccgccggagaagugaggauguguuuaaguaggcaugagguagaauggagaggagacucuccagacacuuguacaugcugagcccaguuguauaauaagaaaaaagaaugguaacucuaaaucgcucuuucccaugcuggaaaugauagccauuacccaccacugauuuucaguaggucuacgcaguccgcuagggaguuaggaugguagauaaaggucaaagguaccauugcuaccacauuuucuuugguuuccaaaaaccugaucuauucaucgaguaauaugacaaauuauuuucuguuugucaguguuauuucuaugaagagacaguauaguacuaugauguugauuuugagguuugcaggaauguuagacuuaaagaguaggucagauagacucacaaacauaaguuuguguugauaucaccuacuuuccugucuaugcucccuucucacuucuaagugucccauuucugucugugugaagcauuuuauuuuuauguauuuauguauucugagauacaguuucacuuuguugcccaggcuggagugcaguggcaucaucucaacucacugcagccuccgccucccggguucaagcgauucuccugccucagccucccgagcagcugggacuacaggcguguaccaccacacccggcugauuuuuguauuuuuaguagagacaggguuucaucauguuggccaggcuggucuugaacuucugaccucagcugauccaccugccucccaagguguuaggauuacaggcgugagccaccgcgccaggccugugagacauuuuauacucuauagcuuagcaucuuuuuaaugauucauuaaauuugagauucaucagugucugaaaacagaaacucuaauuguagucuuguaaaaaugggcuucauuuuuuacaucacuucuuuauugaggguaugagaaucccggauugcugcuuaccagcacuguaugaguaauuuugaaugcaaguauguauuuucuucuuuaaguauuaaucggggccuagaaaaccauguguggcauuucagauaauuuaauucugggaacuggguacacagguguuacaagaugaaagagcacaaaagacacugggguaauccagauaggaagcacuaccaccccuagguuugggggaacagaagagaagaaccuggaagcucagagagguccuccugcagcugguaaucugaucuccuaguggaaugccauucagcugguacucaaccaccaggagagaagaggcacagcuggaguugggaggugcaacacuccucuugcuggagcaaugcugauauuauaacaaugaaaacagcaaagaaaucccuucuucucuccccuuccagucucccuaggcaaaaccuaacaggauacuggcaguaaagucuggaaaacaugguuggcaggcucagccccagagcgaggaauagugcaacucugacaagaauagaagacagggcuuggaagugagacggagagagagagauaaacagcaagcauaaccuuguaggagaguuacagaaacuguaacugccuggguguagcuuuaguuauuaaaaugugcagcugauuacccacaaucauuuaucaaagagcacauuaugauagaucuauucauagagacuuuauggacccgagcccugacuucagugagcuuacaguauuuucuuuucuuuuuuucuucgagauggagucgcacccugucgcccaggcuggagaaugcaguggcgcgaucuuggcucacugcaaccuccgccucccggguucaagcaauucuccugccucagucuccagaguagcugggauuacagucaugugccaccauguccggcuaauuuuuuguaucuuuaguagagacgggguuuuaccauguuggcccggcugacuccagaccucgcgaucugcccgccucuggccucucgggauuacgggcaugagccaccaugccuggcgcuuacaguauuuucauaaaaucauccacucaucccuaagucauuaugaaguugugugguaaagcuuuuuuuucuuuucuugcuuuuuuuuuuuuuuuugagacagagucucgcuguguugcccaggcuggagugcaguggugcgaucuuugcucacugcaaccuccgacucccagguuuaagugauucuccugucucagccuccagaauagcuggaauuaaagccaccaccccuggcuaauuuuuguauuuuuaguagagauaggguuucaccauguuggucaggcuagucucaaacuucugaccucgcgaucccccagccuuggccucccaaagugcugggauuacaggcgugagccaccacgcccagcccaaagcuuauuuuucuuaagcauuauauaaaagcaucauuguuaacuggauuaucguguuauuaguauuaaggaauauuuacaaaguuaaccuauugguaugaaaaauauuugauuagucauacaauuuuguuaguuuuagaugccgcaaauuaggaguuugucuuccucaaggcaaggccacuucuaaacuugaacugugcuguucucaguucuuaacguaagaagggagcuuuauuuaucuagugacaguuugcucuaacaugucauuuaauuuuaauuuucaaaaggaucaguuuggaagacuauaucauagcuauuuguuuuuaaagcucauuuuguuaaaagucaaaguaauacauucauauaauaaaagaugaaauagaaggacuuacaauaaaaaucaauagucuuuugccacucuuuccccaucccgagucccacuuuucagagacaauuagcuguuuuuuguuuauaguuuaacuguuuuguuuauaguaucaucaaacaguaaugccuccauaacucuaaauaauaugucuauaccacuauuucuugauuuaucaaaugggcauuauugacuuuuuuuuuuuuuuuuuuuuuuugagaaggagucucgcucugucgcccaggcuggagugcaguggcacaaucucggcucacugcaagcuccgccucccggguucacgccauucuccugccucugccucccgaguagcugggacuacaggugcccgccaccacgcccggcuaacuuuuuguauuuuuaguagagacgggguuucaccguguuagccaggauggucucuaccuccugaccucgugauccgcccuucucagccucccaaagugcugagauuacaggcgugagccaccacacccagcuugacuuucuuuuauggaauauaagguacuuauuuuuuuaguacuuuuccuuucccuuguacuuuugauaguuacauuguaauacuguuuccaucuccugcuaauaaugucuccugacucccucaccauguaaggauaggauauuaauacucuauacuccuagccauucuuccaccuuucugucccucucccgccuccaaauuucugucagccuuaucuuugcuuuuucauugucaugguucauaacuuuuaccugcuguuuuguauuauauuucauuuucuguauuuuggucuguagucggggucuggagauggaacuacauguacaacuauagcuucauuuuuuuuuuuuuucaacuguagagcccaguggugugggaggguauuuuuuuucuuuccaugucugauaucaucacucauacacucuuugaaagagaauuauccuaggucaaauggauuuuucuuuucuuauguuccauuuuuacucacaauuaagccacauuuuacuuugauucuauuuucacucugacuugagcuguggaauuguuuuuaauuuuuacugcuguggugagauuuccauccauuacccuagugucccccugaggagcaaacccuauaguugacuuuaggcuucuuuaggcuucuugagaaaggguaaaauuucuauccuaguuaugcaguuuauauucuggauauguucaagaauguaaguugagccagccuagguuccccccaccccaccccggguuuggacuguagacugaggcuaggugucagauuuucccuuaggcaguucuugugguuuuucuuuugauaugauaaugcuauugauuagacuaaugcuuucuuuuacauuuaguuacacuuugauuagauuuccuggccugcuuuucuuucugcuuugauuuuuaaaauacucuacacuuaaucucauccauuauguguggauuagacuaaauuuaacucccuuggacauuuccuucaaauuccaguagcuccuuagguauuauugacuacaaguaccagggugcucugggccaagacaaucuuuuucuguguuuucuuccacuaacccacccauacuggccuagagggacaaaaguagcagcucuucuguaccagagaguaccccuaccccaaccucuuguaguuuauauuauaaagaaggacuuuuuaauuuaauuuuuuuuuuaagagagagggucucacucugucacucacacaggagugcaguggugcgaucuuggcucacugaagccuuguccucccaggcucaagcaauccucuugccuuagccuccugaguagcuggggcuauaggcaugugccaucaugcccagcuaauuuuucauuuuuuguagagagggggucucccuauguugcccaggcuugucucgaacuccuggacauaagcaauccucccaccuuggccucccaaagugcugggauuacgagugugagccacuguguccggccaagaaggaccuuuagaugaaggauauauugcaccccaggugaugauccaggguaagaaagauuuuaguaaaauuguuaccauguuaaguuauugcuugggggaauuuuuuuucuuuuuccuuuuuuuuuuuuuuaaaugaaguauugacuaaucugcugaacaccacuggcucugggugauagguaugcuguuuuauuugaaugugguguugagucacaggucauuauguauugccggcgcuuucgucuuacuuuuuauaucaguucagaggaaucacucucaaguccaucugcugccucuucauuuugugcacuguugugaaauuaugcuaggggccuugguuuccuauaguuucuuuauuuuaugucuaggagaacaauauuucaguugcuggaguuaauauagggcuuuuuagaugccugauucagucucuuacacaguuaagaaaaccauccucagagaugacugucugauuuagaaaugaagaaauugaggcccagugcuugugagacuagucaaguaaugagucaagaaggguagaaucgggaagacauagagauucuggcaucaucauaauuaaugucaggcacuuauugcugggcacuguguuccucacuuuaucuggguuaucucauuuaauccucauaucauccuuuugcgaauagguagucauuuuuuuuuucacuuaaaaaaaaugauagaauuguagcuuagagguugaguaacuuguccagggguucuggauaucuuggugauagacugugcuguuuuauaaaauagagaauauuuaauauauuuuuaccuauugacaguucacaucacuuuagcuauccagggaaucuaacuccucauggaggaaagcuaaaaugcuucacuaaauugacuugggagaguggggucugaugauguccagcaauaugucauaugucauaucagucauaucuggcauuaaccaaccugcuucuuuuaugauuuuauggaaacauuguaaguaucauucauaaguaucccacucuaguuaaaagaagucagaaauaccuuugccuuugcuuuucacagggugugcugaauaaaaaugguuagagaggccgggugcgguggcucaagccuguaaucccagcacuuugagagaccgaggcagauggaucaccugaggucaggaguuugagaccagccuggcugauaugguaaaaccccgucucugcuaaaaauacaaaaaucagcugggcuugguggugcacuuguaauccuagcuacuugggaggcugaggcacgagaauugcuugaacccaggaggcagagguugcugugagccaagaucacaccacugcccuccagccugggcaacagagugagacucugucucaaaaaaaaaaaaaaaaugguuagagaggccaaagaaugggagagggagagagguggaaagagaugaggcucugggcagaaauggcaagccugugaagcagacagcccuauugauucaugcugugaacugcauucuggagcaaagaauugaaauccauuaugccaagcgcauagccuacaaaucccuuugaaaagcaguuaggugccaucuaaucccaaaucauuuaaaaauaauucugaaguacccagaauucuaaaaugcccuaagcaguuugucucgaagaacagugaaauggauggaaaaauagcauuuuaaugguaucuuucucucauauauuauauucaauugugugacuuaguguguuaaauuguuuuagaguaguacaaaucugggggcuaggauauauucccuuggauauucugaaacucacauaaaacaggauauggaaggguagcuuaucagguagcuuaaaaauucuuuucuaauuuugccauaauuucagacuuugggaaaaguugcaagaauaguacaaagaauucucauguacccuuuacccagauuuuccaaauguucacauuuuacuguguuuucaaagaccucagaaaauugaaaauuugauuaucuacauagaaacaaaucaccuaaagaauaaagacauagcaggauuaguuuaagagagcaguuacucagaggaacaaaggauuuuagaaucaaaagaucucaagauggagaaagacuucuauaguagagugggacaaaauaagagaaaaauuuuacauaaauaaauaauuauguucuuuuacaugcagccauagaggucauauuucuauaucuaugugguugacauuuuuugguaaacuccagauguguagugcuguauacuguuacaugauagucaaauuuuaaauguguguauauguucauguggguuuguauuaauacaaguagagauaguguuaguguacaacugaagcacucagcuuuucaauauacaucaaaauuuaaaauacauaugccuuuugacccagcaauuuaccuucaagaguuuguuauucuuaaaagaauuuauuuuuuaaaauaaucaaauaauauacaagauuuuuaauaaagauaauacaggcugguuauauuauucuccuguaagauuagucacuucuuccuuuuuuaaaauuuauuuuuauuuauuuauuuauuugagacggagucucgcucugucgcccaggcuggagugcaguggcgcaucucacugcaagcuccgccuuccggguucacgccauucuccuaccucagccucccgaguagcugggacugcaggcgcccgccaccacucccggcuaauuuuuuguauuuuuuuaguagagacaggguuucaccauguuagccaggauggucucgaucuccugaccucgugaucugccugccuuggccucccaaagugcugggauuacaggcgugagccaccgcgcccggccagauuagucacuucuuugcacagaaauuacacugguauauaggguaauuuuaaaaaguuaguuguaaaauauacauaacaauaaauuuaccaucauaaucauuuuuaggcauauaguucaguaauguuaaguacauucacacuguugugcagccaaucuccagaacucuuuaucuugcagaacugaaacucuguacucccagccccuggcgacuaauagucuacuuucugucucuaugaauuugacuacucuaggugccucacauaaguagaaucauacaguauuuguucuuuuuuguggcuggcuuauuucacugagcagaauauccucaagguugauccauguuguagcaugagucagaauuuccuuuuuuuaaaaauugguuuuaaauaaaacuguauuuuuuauagcaguuuuaaguucacagcaaaauugaguggaagauacagauaauucccauauacuucucuuccuuacacuugcacagccucccccacuaucaacauccugcaccagagugguacauuugguuccaauugaugagcccacauugacacgucauuauuacccaaaguccauaguuuacauuaggguucccucaugguauuguacauuacauaguuuacauuaggguucccucaugguauuguacauucuauggauuugaacaaauguauaacccauauccaccauuauuguaucauacagaguaguuucacugcccugaaaaugcuccgccuguucaucccucccuucccccaauccuuggcaaccucuaaucuuuuuaccguccccauaguuuugcuuuuccagaaggccauguaauuggaaucauaaguguguagccuuuucagauuggcuuuuuucacuuagcaauaugcauuuaagcuucuucuacauuuucucauagcuugaaagcucauuucuuuuuagugcugaaugauauucuauugucuggauguaccacaguuuauccauucaccuacggaaggacauuuuggugcuuccaaguuugggcaauuaugaauaaaauuauaaacauccaugugcagguuuuuauguggauguaaguuuucaacuccuuugggucaauacaaaggcguguaauugcuggauuguaugguaagaguauguuuaauuuuauaacagacugccacacugucuuccaaaguggcuguacuauguugcauucccaccagcagugaaauagaguuccuguugcuccacauccucaacagcguuugguguuggcaguguuuugagguuuagauauuuaaauagaugcguagugauaucucacuguuuuaauuuguaauucucccuugacauaugauguugagcaucuuuucauaugcuuauuuaccaucuauauaucuuccuuggugagaucucuucagguguuuugcccuuuuuuaaauuggguucauuuucuuauuguugaguuuuuaagaauuccuuauuuuggauaacaauccuucugauucaucuuuuacaacuauuuccucccugucuauguccugucuucucauucuuuuggcagugucuuucacagggcagaaguuucuuguuuuaaugaaguccagcuuaucgauuuuuugcuuuuauggauugcgccuuuggcauuguaucuuaaaagucauugccauacccaaggucaacuagauuuucuccuauguuaucuuauaggaguuuuaugguuuugcauuuuacauuuagguuuaugauccauuuuguaucaguuuuugugaaggucuaugucuagauuucauuuuuuugaugugugacuguucacuuguuccagcaccauucauugaaaagacuaacuuugccaaacuaauguauugccuuugcuccuuucucagagaucagcuggcucuauuuaugugggucuauuucuggaccuucucuucuguuacauuggucuauuucucugguguuucaccaauaccauacuaucuugauuacuguagguuuaugguaagucuuaaaguugugugguaucagucuucugauuuuguucuuucaguauuuuuuuggcuguucugggucuuuugccucuccauguaaacuuuagugucaguugguugguauccacaaaauaacuugcugggauuuugauugggacaauguugaaucuagagaucagguuggaagaacugacaucuugacaguauugugucuuccuaugcaugaacauggaauaucucucucuauuuaguuuuuauuugauuauuuucaucagaguuuuguguuuuuuuucauauagaucuuguacauauuuuguuagauuuauaccuuacucaguauuucacuuuuugguggugcaaauguaaaugguauuguguuuuugauuucagauuccacuuauucauuucuaguauuuaggaaaacaaccuugucccugcaaccuugcuguaauuacuuacuaguuccaggaguuuuuuuuauugauuauuuuggauuuucuacaucaacaaucaugucaucuaugaagaaagacaguucuauuucuuccuucccaaucaggguacccuuuauuucuuuuuaaaaaucuuauugcauuaguuaagacuuccaguacaauguuaaaaagaaguggugagaggagauuuccuugucuucuuccugaucuuuuuuuuuuugagacagagucccgccguugcugugucacccaggcuggagcguaguggcaugaucucagcucacugcaaccuccaccuucuggguucaagcgauucuucugccucagccuccugaguagcugggauuacagauguguaccaccacaccuggcuaauuuuuauauuuuuaguagagacaggguuuuuccauguuggccaggcuggucccgaacucccuaccucaggugauacaccugccucggccucccaaagugcugggauuacaggcgugagccaccucggccagccuucuuccuaaucuuaaugggaaagcuucuaguuuuucacauuaugauguuaauaguagguuuuuuguagcuguucuuuaucagguugaggaaauuccccucuuucuaauuagcauuuucuuccuuuuuaaaacugaauaauaagugguauguguauaccacauuuuuuuuacccaugcauucaucgauggucacuuggguugcuuccacauuuuggcuguugcgaauaaagcugcuaugaacauggguguacagaugucuauucaagaauagcuggaucaugugguacuucuauuuuuguuuuuuuuuugaggaacuaauauguaaaguuuuauauacaaggacauauuuuauacugcauugauguuuaguuuauaauagcaaaaacuuggcagcauauuugaucagcaagugacugguuauauaaauuaugacacaugcauauaauaaaguauuaugcagcuguuuaaaaaagauaugguagaucuguuauguuuugacauguaacaauguccagauauauuguaauaugaaaaagacagacaauauguauaauaugaaccuguuuuuauuuuaaaucuauauauauguaugcuccaaauuuauuuuucaaaaauaaugaacuucuggggugggggggaguggagauuauaaguguaauagaagagccaacuuuuaaccuuacugcuuuauacauuacuguaucauuuugggguuuacaagaagcacaguuuuuuggguuuuuuuuuggaggggguguuuguuuguuuuugagacagagucuugcucugucucccaggcuggaguacaauggcacaaccuuggcucacugcaaccucugccucccgaguucaagcacuucuccugccucagccucccaaguagcugggauuacaggcgcccaccaccacgccuggcuaauuuuuuuguauuuuuaauagagacaggguuuugccauguuggccaggcuggucucgaacuccugaccucagaugauccaccugccugggccucccaaagugcugggacuacaggcacuugccgccaugcccucaagaagcaguuuuauaagcagaaagaccaauuugaauuuuugggaaaaaaguuauuugacucucacucgucuuugacauacaaagaaaauguuaaguauuucacuuauuuacuaaguguucuuauguucacaaggccaaaugcuagucacugagcuaucuuaaguauguuuuuauuguuauauuugaaugucuuuuuauuauuaaggguaucuguuguuuugugaucugagguauaaaauuaguacagcgaauuuccaucaaaaugguuucacguaagaacaccacucugucauuuuuaugucacauuugcauggugcuucccauuuccugugacuugguguggcacgguaaguagugaaauuggaauuuugucaagguuccucugcucuugaauaaaauaucucuuaguuuaaacauuguguuauauuacacacugaauccuguucuuuuucuuuuuugucugacaguagaacuucauggaggaacacggagugacccaaaccgaacauauggcuaccauagaagcacaugcaguggcccagcaagugcagcagguccauguggcuacuuacaccgagcauaguaugcugagugcugaugaagacucgccuucuucucccgaggacaccucuuacgaugacucagauauacucaacuccacagcagcugaugaggugacagcucaucuggcagcugcagguaguguuguuuggauuagaagcucuucuuuaauuuuuuuuuuuuuuuuuuuggagacagcgucucacucuguugcucaggcuggggugcagcagcacaaucaugauucacugcagccuugaucuuccggguucaagugauucucccaucucagccucuggaguagcugggacugcugauguguaccaccacaucuggcuaauuuuuguauauuuuguagagacagaaaugucacuguguuacccagguuggccucaaaguccugggcucaagcgauccuucugccucggccuccuaaauuauuggcauuacgggugugaguuacuaugccuggccuuuaucacaacuuuuuuaagccuugcaguuauaacuugagccuguauuauacugagacuugaggucuguaaucacuuacuaucaguguuauggcuuugguuuuauuuuuucaucuauucugccuauguuuuggcuuuaaacugaagcauuuauuccaauuacguuaaacagaaucacugacauguauuuagauuuaaauuuaccuucuuuucuauaugcuuucucuuugcccuaccuguucuguuuacuuuucucuuucuuggcguuuucuuuuguagugauugaaaauuuuguauuuuuucauuuuuuucuuguuaguuugaaaguuauaagcuuuuacuauuaucaauaccuguagaaauuguaacauacauccuuuauuuaucaaugccuuauguugacuaggcucaguggcucacaccuguaaucccagcacuuugggaggccaaggugggaggaucacuugagcccaggaguuugagaccagccugggcaauguagugcaaucccaucucuaccaaaaaaaaauuagcuggguguggugacgugcucccuagucccagcuacuugggaggcuguggugggaugacugaucacuugagcccagguguuugagggugcagugagcuaugauuacaccacugcacuacagcgugagugacagagugagagccuguguccaguugaaaaaaaaaaaaaaaaggaaaagcaaaacguuguauguacuuggaacuuuuaaccucuacagggauaauacaaauuucuuagaacacuugcauuucaugcgcccauccuauaugcuauuguuguccuuuguauucauuuuugguauacaguuggcucucuuuaucugugggcuccacaucugcacauucaaccaauuuugaucaaaaguauuaggaaaaaauuaaaaguaacaauauaacaauuaaaaauaauacaaauaaaaggccaauacaacaacuauuuguauagcauuuacacuguauuagguauuauaauauuaguauuaguaaccuagaaaugauacagaaggacgugaauaggucaugugaaacuacuacaccauuuuauaucagggacuugagcaucuacacaucaagaugcuagaaacaaucucaagaggauuugaagggacaacuguauuuuaaacaccacaggacuuuuuuuuuuuuuuuuuuuuuuugagauggagucucacucugucgcccaggcuggagugcaguggcacaaucuuggcucacugcagcuucugccuccuggguuggagcaacucuccugucucagccucccgaguagcugggauuacaggugugcgucaccaugcccagcuaauuuuuguguuuuuaguagagaugggguuucacccuguuggccaggccggucuugaauuccugaccucgggugauccacccaucucggccucccagagugcugggauuauaggcgugagccaccgcauccagcgaacaauauuuuuauuuaaaaaauaauguuaauuuuuuuuccugcaucuccaacuggucuccugagaugguuuuacuucugccuaaagacaccauuuaauauuugcuuuaacauggaucugcuaguaacaaguucuauuuuugcuugucugugaauguuuuuacuuaaacuucaaccuugaaggauguuuucacugaguauggaauucuagcuuggugguuauucuuuccucauguugaagguacuguuccacugucuucuggauuccauugcugcuauugagaauucagcuauuucauucuaaccgcuacucuuucaaagauuaucucccacauggccugccccccucucccggaaauuuuagccaugagauuuugcuucugcugcauuccaucucuuuucauuccauggcuccaguuacuuauguuagucuuccucacuuguaugucucuuaaccaucuguucuguauguaucaucuuucuguguaguuucuucugucuuucagcuugugaaagacagaagauuuucuucuuuagcuguuguauuaguccauuuucaugcugcugauaagagauacccaagacugggaagaaagagguuuuaauggacuuacaguuccaccuggcuagggaggccucacaaucaugguggaaggcaaggaagagcaggucgcaucuuacauggaugacagcaggcaaaaagagagagagcuugugcagggaaacuccuccuuuuaaaaccaucagaucuugugagacuuauucacuaucacaagaacagcaugggaaagaucugcccccaugauucaauuaccucccaccggguccuucccacaacaugugggaauuaugagaguacaauucaagaugagauuugaguggggacauagagccaaaccauauuauuccaccccuggccccucccaaauuucauguccucacauuucaaaaccaaucaugccuuucuaacagucccccaaagucuuaacucauuucagcauuaacuuaaaaguccacaguccaaauucucaucugagacaaggcaagucccucugccuaugagccuguaaaaucaaaagcaaguuaguuacuuccuagauacaguggggguacagggauuggguaaauacaggcauuccaagugggagaaauuggccaaauaaaagggcuacaggccccaugcaaguccgaaauccagcagggccgucaaaucuuaaagcuccaaaaugaucuccuuugauuccaugucucacauccaggucaugcugauacaagagguggggucccauggucuuggacagcucugcccccuguggcuuugcaggguacagccucccucccagcugcuuucaugggcuguuguugagugucuguggcuuuuccaggcaaaagaugcaagcugucgguggaucuacuauucugggggcuggaggacaguggcccucuucucacagcucuacuaggcagugcccccgaagggacucugugugaggucuccgacccaaccccacauuucccuuacacacuguacuugcagagguucucuaugagggucccgccccugcagcaaacuucugccuggauauccaggaguuuucauacauccucugaaauccaggcauagguucccaaacuccaauccuugacuucuguacacuugcaggcucaacaccuuuguggaagcugcuaaggcuuggggcuugcagccccugaagccauggcccgagcucuguguuggccccuuucagccacagcuggagcagcugggauacagggcaccaagccccuaggcugugcccagcacagggacccugggcccagcccuugaaaccuccuaggucuccaggccuaugaugggaggggcuacugugaagaccucugacaugcccuggagacauuuuuuccauugucuuggggauuaacauucgucuccuuguugcuuaugcaaauuucugcagccagcuugaaguuuuccucagaaaaugggauuuucuuuucuguugcauuaucaggcugcaaauuuuccaaacuuucauguuuuccuucccuuauaaaacaaugccuuuaacagcacccaagucaccucuugaaugcuuugcugcuuagaaauuucuucugccagauacccuaaaucaucucucucaaguucaaaguuccacaaaucucuagggcaggggcaaaaugccaccagucucuuugccgaagcauaacaagagucaccuuugcuccaguucccaacaaguuucuuauuuccaccugagaccacaucaaccuggacuuuauuguccauaucacuaucagcauuuugggcaaagccauucaucaagucucuuggaaguuccaaacuuuccuacauuuucccgucuucuuuugagcccuccaaacuguuccaaccccagccuauuacccaguuccaaagucacuuccacauuuuuagguaucuuuucagcagcaccccacuccugguaccaauuuacuauauuaguccauuuucaugcugcugauaaggacauacucaagacugggaagaaaagagguuucgguggacuuacagaucuauguggcuggggaggccucacaaccauggcagaaggcaaggaggagcaagucaugucuuacauggauaacagcagucaaagagugagagagcuugugcaguggaauuccucuuuuuuuaaacccccagaccuaaugagacuuauucacuaucacaagaacagcaccggaaagaccugcccgcaugauucaguuaccucccacuagguuccucccacaacaugugggaguuaugagaguacaauucaagaugagauuuggguggggacacagccaaaccauaucagcuguguuuaaggugccuuuuuuauguucucuuuucuuuguuuuuucuuuauuuauuaaggugcuucuaaaucuguucauugacuuauuaauuuugguaauuguuaauaguuuaaccaaaacuacuaaccaaguguuuuuuuuccuccaguuuuagaauuucuaguguguguguguguguguguguguguguguguguguguguuuccuccgagauuugcacugaacgguuuccaauaguggaaaaaaauuucuuuuaaacaaauaauuuuauaauuuaccugguaauucucucucaaguuucuguuacauguuguuaaugucauuucuuguucacguuggcucuuuucuugguguacuauuauauuucaaugaauacuggaugcuguguuuggaaaauuauuucuagaaauaauuuggggucuaguauaauguuaucuuccucuagagaggauuuuuguuugcuucugcgagaugcccgagggcacuagcaauccuggaucaucuuaauccaauuuaagguuuauuuauuuauuuauuuauuuauuuuaguauuuauugaucauucuuggguguuucucagagagggggauguggcagggucauaggauaauaguggagagaaggucagcagauaaacacgagaacaaaggucucugguuuuccuaggcagaggucccugcggccuucggcccuguuugugucccuggguacuugagauuagggaguggugaugacucuuaacgagcaugcugucuucaagcaucuguuuaacaaagcacaucuugcaccgcccuuaauccauuuaacccugaguggacacagcacauguuucagagagcaugggguuggggguaaguuaaagauuaacagcaucccaaggcagaagaauuuuucuuaguacagaacaaaauggagucuccuaugucuacuucuuucuacacagacacaguacaaaucugaccucucuuccuuuuccccacauuucccccuuuucuuuucgacaaaaccgccaucgucaucauggcccgcucucgauggucgcugucucuucggagcuguuggguacacuucccagacggggcggccgagcagaggcgcuccccacuucccagacgggguggccgggcagaggcgcaccucacuucccagacggggugguggccggacagaggcgcuccucaccucccagacgggguggcggccgggcagaggcgcuccucacaucccagacaaugggcggccgagcagaggugcuccucaccucccagacggggcggccgggcagaggcgcuccccaccucccagacgggguggccgggcagagggcugcucacaucccagacgaugggcggccaggcagagacgcuccucacuuccuagacgggguggcggcugggcagaggcgcuccucacuucccagacggggcgggcgggcagaggggcuccucacaucccagacgaugggcggccaggcagagacgcugcucacuuccuagacgggguggcgggcgggcagaggcuguaaucuuagcacuuugggaggccaaggcaggcagcugggagguggagguuguagcgagccaagaucacgccacuguacuccagccugggcaacauugagcauugagugagcgagacuccgucugcaaucccagcaccucgggaggccgaggugggcagaucacccgaggccaggagcuggagaccaguccggucaacacggcgaaaccccgucuccaccaaaaauacgaaaaccagucaggaguggcggcgugugccuggaaucccaggcacucgccaggccgaggcaggagaaucaccggagcccagggcagggagguugcagggagcggagaucuuggcaguacaguccaggcuccccaagagagggagacaguggagacgggaaagggggagggggagggggaaagggagggagaggguaggggagagggagagggagagggauccaauuuaagguuuuaaaauuuucugggcuacuaaaugacuuaaagcugggcuacauuuuauaucuuucacuuuccuguuuacauugaacauuuagcaccauggugaaaagacuucauauaaaccaugccugaauggguaugguauuagauauugaucuuagaagguauuuagaaaagcuagacaagaaauuaaugaugaggaguggccaaaauacuacauguuuugaauauaugcuguauuuaagaagaggaagacagauucaaugaacaacaacuuuauuacugucaguuacuguccacuguguauuuccggaguggugaauuuaaaaauaagucuuaggggcaaaacacuugaaauguuuguaaaauauauuuugugaaaugcuuaugugucccagcagagggcaucuugacauaaugaauccagguccacugcuuuucuaugaaggaagaugguuuuaagacauggcuuugcuguauuacuguacugcuuugugauaguguuaagaccaggcaaagacuuuaauuugaccccuuuguguggcacauguggaaagugagacacagcugguagaaaugacuuccauuugaucauuuaauauucaauuauugaggaauuauaauguauaguacauauauguaaccuauguagauacuaugcacaaggcaggcaagaguuugcuucuuaggagugcgaaaggcuuauuggggggagaaaagaguuuguuucugaaggagcuuucauccaguggugggggagagcuaccaauaauaaaguaaaauaauuugagaaagcauuggaugcucugaauaaaauaaugcgggaagguaauggagagagaaggacagcagauugcugcuaguuuggguggucugggaaggcuucucugaggaggaagguugugacugacaggcaguuaggugucagcaaagggaagugcauuucagacugagaaacacugaaagcaaggacuugcagaugggaaaugggaaggaggccagugugguuggagccuugugaggcaggcaugagucagaccacccagggccuaggggcugugugugguaaggaauuucgagaggcagcagagcacagggcuuaccugcccaggcucuggaaucaggcuuccuggguuggaaucccaacuccacuuaaccagcguggggauuuuucugaggagcuggucuguagcauucaucauaucugaaaggugacccagaaaagguaaaugaccauucacuauauuguguugccugucagaaacacuucuaauucucugcagcacagacagccccugauuauuguugauuuucaagaaaaaaaaguuuauuuguagugcaacuaaacgaaaucuucaaguaauaaaaacaauaucucaaguugguugaccucuuuuaguaucaaucaccaguauguuguuuguuguuguuguuguuguugguuuuuuuugagacaggguuucacucuguuguccagacuggagugcagugguacaaucauggcuuacugcagccucaaccuccuugggcucagaugauccucccaccucauccucguggacaggugcacgccaccaugcccagcuaauuuuuuaaauuuuugcagacaugccguuuugccauguugcccagggcuggucuugaacuccggggcucaagugauccuccugccuuggccucccagaguguugggauuacaggcgugagccacugggccuagcccuagaggacuucuuuuuaaacaaaauuggauuuauuauuucauuuucuuugaaaugauaaaggauagguuaauaaagaaguggagaaagauucacguggucuauagacguaauuaauaucuugagagugauaguuuugguaaauugugcagcaaguagaaaauacuugaauauuugaaucauauggagaaguaucaagauugacauaacaaaugcaugugcacccacugcccagcuuugucaguuauuacugcuuucacauguuugcaucaaauguuuuuuaagaaauaaaaaguacagauaugguugaaauucucaguggaacucuuucuaauccugcucccuucccucccucccuccacugggguaaccaguauucuagauuuggucuuugucauucucuugcauuugucuauauuugcuauuaugugucuguaugauuaaacaauauuuagcauuguuuugcauguguuaaauuuuauauuaaugguaucacucugauacuauguuucuguaauauguuuaucucguucaacauuuuucugagauucacccauguugauaauguggcuguuuuuaacuguuauaugguauuccauucauuaucugaguauuucuuuuucuguuguuguuuuuugagauggaguuucacucuguugcccuggcuggagugcaguggcacgaucucugcucacugcaaccucugccuccuggguucaagcaauucuccugccucagccuccugaguagcugggacuagaggcacacaccaccauaccuggcuaauuuuuguauuuuuaguagagaugggguuuaccauguuggccaggcuggucucgaacuccugaccucaagugaucugccuaccccagccucccaaaguguugggauuacaggcgagagccaccgcauccagccugaauauuucacauauugguagauaaucagguuguuuguaauuuuuucuguuuugacaauguagcacaguaauacauuuuacauugugacccagaauaaaugaguacacauauagccaaaacuacaauuuuuaaugaaauaauacuuaaccccuacugcaaauuguauacucugugauauguucuagucuguucuauuuuauuagaaaaaaauacacucaugagucacugaaaggucauacuagcuguagcuugaaaaguacuacuggaagauauacccaggaggggaauuggagggccaaagauguccauuuucaacuuuacuagauauugcuaaaugucuuuccaaauccuguucauuuacauccccacaagcaguaugcuguagcgccuguuacuucucauucucaccaucgguguuaccagucuuuuucauuuuugcagaucugguagguauaaaauggcaucucaguguugguuuaauuuguguuuuugagcuagagguuccagcgagugcaguaagacaaaguagagcaccauuuuggaucuuuauugacgucucaauuuucuuucuuugccuauuuccuguuuauaccuuugcccauuucccaacucaguuuuuuggucuuuuuuaugucaauuuauaaaaauuauugaucuauauuuuguauuccuuucccaauaauauguauuguaauuauuuucucccaguuuguugcccacccccauuuauuuauuuuuuuguucaugaagguuuuuauuuauauuauugugaaauuuauuaaucuuuuaccuuauaguuuauccuuucgggaucuuguuuaaggaauucuucuuaacucugacuuuauaaaauauucuauaguaguuuauuguagaaguuauaauuuuuuuaauuuucaauuuuaaagguauuuauuuauuuauuuauuuauuuauuuauuuauuuauuuauuagagauaggaucuuacucugucacccaggcuggagugcagugaugcaaucauaguucucugcagccucaaacucuuagucucaagugauccuccugccucagccucccaaguagcugggaccucaggugugcagcaccaugccugguuuuaaauuuuuuuguagauacggagucuugcuauggugcccaggcuagucuugaacuccuggccucaagcaguccuccugccuuguccuuccaaagugcuggauuacaagcuuucuuuuguuuuucauuguuuuauugagguuauuguuuuacauuuaggccuuuaauccaccuguaauuuauuuuuguauguaaggaucuaauuucauuauuuuuccauauggauaaccagcaucauauauuuaauagcccauacuuuuuuuuaucuuucugacacaggaggauguuuaugaaaucugcaauucaguugcuuugauuugucuaucccugagucaguuccacacuaguuuaaugacuauaguuaugcucuuauuuauuuaucucaucucauccuucuaaucaguggagauauaaccuuaaugaguauagccuuguaauuacuaauaugugguaggaugaaugccuucaaauucuuaaaaucuuaugaauuguuuuggcuauuuuuggccauuugcacuucuauuuaaauacugggaucaguuuaucaaauuccacaaaaucccauguugagaguuuuauuugaacuguauuaaauuuauaaaucaaucaaaucaagcagcuuuaugcacaguagccuaaaacuggaaauaguccaaguauccaucagauagaagaauagguaaacaaacugguuuauccaaacaauggaauauuacuuggcaacaaaaaggaaaaaacaacugguucauguggcagcauggaugaaucuagaaacauuauucuaagugaaguuuuaagugaaagaguauuacuauaugauuuacuacuuacuauaugauuccauuuauuuaaagcucuagaauaggcaaaacucuaauguauggugaaaaaaagaagaauucuagguauugcugagaaguaaggaugggaauugacugagaagggacaugaaaggacuuucuggagugauguuauaggucuugaguuuccucuccuuuccccuccccuccccuccugucuccucuccuuuuuugagacggagucuugcuccuucacccaggccagagugcaguggagugaucucgguucacugcaaccuccaccucccagauucaagcgauuuuccugccucagucuccugaguagcugggacuacagaggugcaccaccaugcccagcuaauuuuguauuuuuaguagagaugggguuucaccauauuggccaggcuggucucaaacuccugaccuuaggugauccucccaccucagccucccaaagugcugagauuacaggugugagccacugcgccuggccagaucuugaguuuuaugaguauauacauuuuuaaaauguauugaauguauacuuggauuuguauacuucacuauaugcaaauuuuaccucaaaagaaaaaaauuauaaaauauugaacucuagcuaaugcuaugccugcugaaguauuuagggggaucauauugauauuugcaguuugcuuugaaacacauuuuaaaaaccccagugugaguugaugaauggauagaacgauggauagauauguauaauaagauguuaaaauucaacuuugcacauauguuuuuaaguuuucauaauaaaauauuggacuccuacaacucagcugcaagaaaccaaauaacucaauauaaaaaaugggcaagggacucgaauaaacaucucuguaaggaagacuuagaaaucaccaacagguuagaugcucaacuauuaucaaaaauauaaacuaguggcggugaggucguagagcaacuggaacccuuauauacuauaggugggaauguacagugguccagccgcucuggaaaacaguauggagauuccuccaaaaaauuaaaaauagaacuaccauauaugauccuggugucucacuucuggguauuuauccaacagaauugaaaucaggaccccaaagagauauccacacucccuuguucauuguuguauuauucacaauagcaagaugugaaaauagccuaaaugcccaccagcggaugaauggcuaaagcaaaugugaucuguauguacaauggaacauuauucacccuuaaaaacacaaggaaaugcugucauaugugacaacaugguucaaccuuggggacauuaugauaagugaaacaaaccagucauagaaagacaaauacugcaugauucuacuuauagaagguaucuaaaauagucauagaaacagaggagaauggugguugccagggucugggggugagggacagauggggaguugcucuucagugaugcaaggggaauaaguucuggauagccguacaacauugggcuuauaguuagcaaugauguguuguccacuuuacauuuuaagagaguagauaacaaacauguuaaguguucuuaccacaauuuugaaaaauaaguaaaauguugguaaaugcagccauaaaauuuuuucuguaacagcuauuuaugauggaaagaaagguaaaaagcaguugcuuauuuuuuauuugcuuugagguucuuuagagggguuuaagucaggcugauuauauuacuaacaacauguagaaaaguucauuuagguuuacagggagguuuauuuuauuugagccacuuagaauauauaugccaauauacagaugagcaauuuaauuuuuauuuaagccuuuuacaagauucauaaauaaggauaaagguaaaaugucuuuuuaaaaagauugucuuugauauguugaggucccaggaaucagagacuucaauaguuccuuugagucuacccuccaucuacccuucaaaagacaaaacaagacauuauacauuaguuucaaggcaagccagacuaacuuuuauuaacauuuucucagagugggaaaguuaucucuuuucugccagaaugccuucaucaacuugaccuuguguugaacaucuccauuuuuggcacaauucccagauguagaagaaaauuuuuucaauuaagauguuauucauucagauacuccuuuagguguuguuggaguuccaaaugugagugauuaucuccaacuuccuuaacuuggcauugucuuggaguaauggaaacagggguacagggauagaaguaaauacugaaaucuguaaauuuuuucaauuuuggcaaacuucuccucucagugcuacaauuuuuccuagcaccucuaagaauauugccuuuacaguaugggcaugcuggcaaaacaaagccaaagaaaaacaacauuauacaaaauucaaacuagugugugauggggagguguaagucauuugcuuuuuuaaaagauucauuguauguuuuauugguaaaucauaauaugaaucauguuaaacaauagugaaguauauugauaauaucaggaucauucuuuauuuaccgacaacaauauuaggaaagcagugcuaccuuuuuuguaccuuuaauuguuucugucuugaacaguuuacaggcagcugccuaaucucagcacauacguuauuauuucagguccugugggaauggccgcugcugcugcuguggcaacaggaaagaaacggaaacggccucauguauuugagucuaauccaucuauccggaagaggcaacaaacacguuugcuucggugagggcucccuuauccauauuguuacuauuccucaaauacuuccuguggaugacagacuuagaacauaugugauuagguuugucaaggaugcuugguucgauuccuugaugacagauguagacuuaaaaguauucuuacaaaauuaaaugcaugaaaacaaagaaauacgauuuaacagauacguaauaucacauuaauucauucagaaaaguuguaugccugcuaugugcaagccauuguuguagacauugggcauggaagagugaacaaaacaaauugccuuaaagagcuuguauccugcuagagggggaaagaaaaaaacaauaugcaauaugucagcugaugauaagugcaaugggaaaaaaauacaguggaguaaggaaaauagaaaagucaggagguagggggauauagucaguuuucucuauuacggggauggucugggaaauccuuuuuguuaaggcagccuuugaacagagacuugaaggugcugaaagagcacacauguugaugcuggggggaagaacaucucaggcagggugaguaucaagagcaaaggccccgaggugugaaugugguaguuguguuugaggaacagccagggagauaugagaggauguucagagcaguagagaagagccacgccaggagaucuuuuuuuuuuuuuuuuuuuugauagauguggucuugcuauguuguccaggcuggucugggacuccuggccucaagcgauccucgugccucagcccccaaaaugcugggauuacaggugugggucacuucacccagccuaggagaucuuauaguccaauaucaggggcuugacucuuacucugagugagaugagaugucauuguaggcuuuugaccagagcaguaguaucaucugacuuauauuuuuaaagaaucacucaggcuacuguguugagaauagacuguggggauacaagaauggaaucagggagaccaauuagguggugauuauaguaaucuaggccagaaaugauagugucuuaaaaccaacauggcagcaucauggauaguaagaagugaucagguucuagauguauuucgaaagucaacucaucaugauucauugacauggaguuugagagaaaggagugcugggugauuuuuggucugauuacuagaaggauugcgaugacauuuacuggaggaggagcgagcauggcagugagggugaggcagaaucaggaauuugguuuuggacaugguaaguuugugaugccucuaaccauuaaguggagauacaaaauaagcaguuggauauaugagucuggaauugaaaugagaggccuuagcugaagauauuauaagcauauagguaguauuuagaacuaggagacuggaugaggucacuuagggagugaguauggacugaggccugaagcacuccaccuuuuagagguuagagagauuaaaggaaccagcaaaagaaucuaagaagcaaccagugagucaggaaacaaaccaagagagugguauccuggaaaccagguacaaaaagugugucaggaaggagagcaugugaucagcuaucaaaugcugcugauggguugaaaaagaugccaacugacuauuagauuuaguaacauggaguucaugauugaacuugacaagaguauauucaaaggagugguaagggugaaaagauuggaauagcuuuaagagagaauagggagagaggaauuggagacagugaauauaaaccauuguuucaaggaauuccaucagauuucuuguuugauaagugguccuuugcccaccacauuucagaauucugaaauguagaacuuugaaaucaucucccaugauuucagagggaagaggcaguguuucuguuucauccauuguuacuauauuuuaaaaagcuguuuucggggucgggcgcgguggcucacgccuguaaucccagcacuuugggaggccgaggcgggcggaucacgaggucaggagaucgagaccauggugaaaccucgucucuacuaaaaauacaaaaaauuagccgggcgcaguggcgggcgccuguagucccagcuacucgggaggcugaggcaggagaauggcgugaacccgggaggcggagcuugcagugagcggagaucgcgccacagcacucccgccugggcgacagagcgagacuccgucucaaaaaaaaaaaaaaaaaaagcuguuuucgguuugaugggugcagcagaccaccaugucacauguauaccuuuguaacaaaccugcacauguaucccagaacuuaaaguaaaauuaaaaaaaaauuuuuuuaagcuguuuuuggcugggcaugguggcucaugccuauaaucccagcacuuugggaggccgaggugggcggaucaccugaggucgggaguuugagaccagcuuggccaccauggugaaaccccaucucuacuaaaaauagaaaauauaagccaggcaugguggcaggcaccuacaaucccagcuagucgggaggcugaggcaggagaauagcuuuaacccaggaggcggaggcugcagugagccgagaucgcaccacuguacuuuagccuaggcgacagagugaaacuccaucuaaaaaaaaaaaaaagcuguuuucauuucauccucacuugugaaauacuguaggacuaagaauaauuauuuauaucacaaugaaaaucugaagcuacaacauuuuaaaagcauagguauaccucagagauauugcagguuugguuccagaccacuacaauaaagcaaguaucacaauaagucacagaaauuuuuugguuucucaguacauaaaaaaguuguguuaacacuauacucuguuaaguguugcagugguauuauaucuaaaaaaaaaaagcaauguacauaccguaauuuuaaaauacuuuuuuuuuggagacagagucuagcucugcuguccaagcuagagugcaguggugugaucauggcucacugcagccucaaucuccugggcucaagugauccucucacuuagccucccaaguaguugggacaauaggugcaugucaccauaccuggcgaauuuuuucuucuuucuguaaagacggggucucacuauguugcccaggcugggcuugaacuccugggcucaagcaauccucccaccucaaccucccaaagugcugggauuacaggugugagccacugggccugaccacuaaaacacuuaauugcuaaaagauguuagggcucaucugagccugcagugacucauaaucuuauugcugguugacggucuugccucgauguugaugacugcugacugaucagggugguuguugcugaagguugggguggcugcggcaauuucuuaaaaauaauacaacaaauuuugcccuaucgauugacucuuccuuuccugaacgauuucucuguaacguggugcuguuugauagcauuuuacccacaguaagacuuucaaaauuggaguuaauccccuccaacucugcugcugcuucauaaauucaguuuguguaauauucuaaaucuuuuauugucauuucaacaauauacauaacaucuucaucaggaguggauuucaucucaggaaaccgcuuucuuugcucaucaauaagaagcaccucucauccauuggaauuuuaucaugauauuguagcaauucagucccauuuucaggguccacuuuuaauucugguucuuucacuguuucuacugcauccgcaguuacuuccuccacugaaguguugaacuccuuaaaaucauccguaaggcuuggaaucaaguucuuccaaacuuccauuaauguugauaguuugaccuccucccauguacuugcacaugaauuacaaguacucuuaauggcaucuugaauggugaauccguucuagaagguuuucaauuuauuuuacccagauccaucagaggaaucacuauagcagcuauauccuuucaaaauguauuucuuacauaaaaagaccugaauguugaaaugacuccuugauccaugggcugcagaauggauguuaucuuagcaggcaugaaaacagcauuaaucuccuuguacgucuccguuagagcucuugggugacuaggugcauugucaaugugcaacaauaguuugaaaggaauuuuuuuuucugagcagugggucucaacaguggucuuaaaauauuccauaaaccaugcuguaaacagauguacugccauccagguuuuauuguucuauuuauagaggacaggcagaguagauuuagcaugauuuuuaaaggacccuaaagucacuagcugcauuagccccuaacaagagagucaaccuguccuuugaagcuuugaaaccuggcauugacuucuccucucuagcuaggaaaguccuagauuguaucuucuuccaguagaaggcuguuuuaucuacauugaaaaucuguuguuuaguguagccacuuaucuagaucuucuggauaacuugcuccagcuucuacaucagcacuugcagcuucacuuuguacuuuuauguaauggagauggcuucuuuccuugaaccucaugaaccaaccucugaaagagucagggcuuugcucugcauuaggcuuuggccuaugagaauguuguggcugguuugaucuuuuauccggaccacuaaaacuuucuccauaucagcaauaaaacuguuuugcuuucuuaucauuuguguguucauuggaguagcauuuguaauuucccucaaggacuuuucuuugcauuaacaacguggccaacuguuuggcauaagcggccuugcugucagccuaucuuggcuuucaacaugccuuccucacuaagcuuagucaugucuagcuuuugauuaaaagugggagaugugcgacucuuccuuaaaguugaacacuuagaggccauuguaggguuaucaguuggccuaauuucaauacugugucucagggaacaggaaggccugaggagugggagagaggcaggaaacaguuggucaguggggcauucagaacacacacaacauuuaucagucaaguuugccaucuuuugugggcacugucgugccccaaaacaauuaaaauaguaacaucgaagaucacugaucacagaucacuauaacagauuauaauaaugaagaaguuugaaauauugcuagaguuaccaaaaugugacacagagacacgaagugagcacaugcuguuggaaaaaaauggcacugaucaacuugcuugacauaggguugccacaaaccuuuaauuuguuuuaaagaaagaucccagauaguaucugugaaacacaaaauaacaaagcacaauaaaacuagguaugcuuguaguauuuuuggacaaaauuaucucaaugaaauauaaacaaugagauauaaacaaucaauaaaagauaguaaaagcaaaucauuugaaccccuuuuauuaagcauggagaugauauaauaaauucuguaagagcacaucuugguugcauuuuuuuuuuuuuuuuuuuuugagaaaaagucuugcucuguugcucaggcuggagugcaguggcaccaucuugguucacugcaaccuccaccuccuggauucaagcaauucucgugccucagccucccaagaaucuaggauuacaggcgugugccaccaugucuggguaauguuuuuguauuuuuaguagagacggguuuuacaccauguuggccaggcuggucucgaacucguggccucaagugauccgccugccuuggccucccaaagugcugggauuacagcaggcaugagccaccaugccuggccaguuguaaucuuuauaauuguaaguagcaguaagugauguugcucagaucaagaagaaugauaccauguucaaaauugugucauggcuaugucccaaagcaaaaccuucaguugagccuucuaucaguagucuuuaagaaaaagguauguacauauuucugcugaauaggauagcaaaccucacauuccccuuuucacauuuuacguaaaagagcauaucugaucagaauaaacugucuuaccucauuugugucuaugucacuguaauuuccgucuuuuuaaaacuuuuuauucuuguuuccuuuucugauucaggaaacuucgagccacguuagaugaauauacuacucgugugggacagcaagcuauuguccucuguaucucacccuccaaaccuaacccugucuuuaaaguguuuggugcagcaccuuuggagaaugugguaagucagaaccaagcuguucucauuugcccuuugcuuucugucggcugcuuccauucuucugauccucugucaaguauaacaguuggcauuucuguuacccccuaauccaggcaugggaguggggacuaguuuucagacugcuuuaugcauaucaaaacaaaaugaucauuacucuuuuuacuuccuacgucaagguauuuuaccuccccagaugcaauggguggccgggggaaggggggagggggcggggaaacaagguguuuuguuuguuaggaaaccaaugcaggauuuucuaagaaaauuacugauuuauaucagaaacaaaauaauagauaauuccaaggugucaacuuccugagggaaaccugggggcauuuuauugaucaguuuauuugaguuacauauuugaaauaucuuacauuuaucaaagaauugauuuaauacugugcuccaaauauagaacuauauuugaacauuuugauuguauaacuauccagagcuaauuuuauaaaaauagucuuuugccccugcauacuuauacaauaggaacuauucuuucuugcgccaaauuaacuuugaaucauuaguagauuaaugaucuguaaagauuuaaauugcauuuuguuuuuauuaggguaaaauuuauuagcuuaaaaugacauuuauuagaugucucccauauugaauauaggcauuuuuugaguucagaauuaguaaucaauugaucgaaauucuguuuguuguauuuuuuucacaccaucuuccugucccugaaauguuguggguauuucuuaacauuuuugaguucuguuuugaguuuuuccaaaaauuccugaagcccuacaauuaggauguguuaggaccuuuccuuagaagaauauaguagaaggcuccuaguucaaaauggugccugagaaauagccuuuacugucacacuguugacaaacaugaaaucugggcauuucuucucuucuuuaguacugaaaaucuaaaacaauacuacuacugguaguaguaaagaugaugcaaucuaugaaaaagauucaucuagaagacucagaaaaauacuucagaaaauuacucacugcaaaaaaaacuuuuuaaguuuugggaaacuguuggaguccuccauagaauacaagaagauauagacucuguuaaacaggaugcacuagacugagauaaaaagcauuuuaccuuugacugacauugauaaauacagguuagggacuugcaaguaccaguaaaauuagaagcagaauauaucuuccagagcaccgaagaaaaaaaacaaaaccaagucucuguauaaaagauagaaaacaaggaagaaauguuuaaaaacugaauaaaacacauagucuagaacacaauaauacaagugaggccaguuaauucuguuauaaaccauacauauaaauggguuaaagugccuuguuaaaggcauagauguucuuucagguuggaacaacaauccaaaucaaaccuuccucuauucaauguaugugucauacucacagccacucacaaauguuaaaagcagcugcaaguaauagaaucaagaaagugaaaagacaacaugcagagugggagaaauauuugcaaaucaugucugauaaaaaaacuuuuaucauauguagagaauauauaaagaauucugauaugucugauaaaaaaacugauauauauugagaauauauaaagaauucuuacaacucaacaauaaaaagcaggcagaucaugaggucaggaguucgagaccagccuggccaauauggugaaaccccaucucuacuaaaaauacaaaaaaacuuagccgggccugguggcacaugccuguagucccagcuacucgggaggcugaggcagaagaaucucuugaacccaggaggcagagguugcagugagccaagaucgugccacugcacuccagccugggcaacagaucaagacuccaucucaaaaaaaagaaagaaagaaaagaaagacaacccaauuuaaaaauaggcaaaagggccacacacaguggcucacgccuguaauccuagcacuuugggaggccaagguggguagaucacuugaagucaggaguucaagaccagccuggccaauauggugaaaccccaucucuacuaaaaauacaaaaauuagccagacgugguggcgggcgccuguaaucccagcuacucuggaggcugaggcaggaaaaucucuugaacccaggaggcagagguugcagugagcccagaucacaugccacugcacuccagccugggcaacacagccagacucugucucaaaaaaauaauaauaauaaaaauaaaaauaggcaaaaggucugaauagauauuucuucaaagaagauguagaaauguccaacaagcacaugagaacuaaugauaaauaauuauuuaucauuaaucauuauuauagucauuuaucauuaauaaucacauuucgauuuucauuucccuaaugcugaugauuaauaaucauagucauuagggaaaugaaaauaaaaaccacaguaagauaccucuucauacccacagggauggugaaguuggugaagauuuggagaaagaaaaagcaaaaugguacagcugcuuuggaaaacaauuugucagucucucaaaaugguaaaaguaaaguugccauguguccuagcaguucuauuccuaaguuauacccaagagaacugaaagcauauguucauacacaaacuuguauacaguguuuauagcagcauuauuuauaauugccaaaaaguggaaacaacucaaauguucaucggcugaugaauggauaaauaaaauguggcauauccauaggauggaauauuauucagcaagaaaaagggaagaaguacugauauuauacuacagcauggaugaaccuuuaaaacauugugcuaagcaaaagaacccagucacaaaagaucacauguuguaugauuccauuuauaugcaauguccaggauagauaaaucuuauuuauagagagagaguggauuagugguugccagagacuggggaaggggaagagagugacgccagugggcaugggguuucuuuuagguggaaugaaaugcucuaaaauuagauuuuggugguaauuuuaggacccuaugaguauaaagucuuacccuuuaaaugggugaauuguaugguaugacaaacuaaauaaugacccccagagaugugcaggucccaucccuggaaccugugacuauuaccuuauacagcaaaagugcaguuguaauuaaaagggucuugaauggggagauuauucucgauuauccagguaggcccuaaauguaaucacaagugucuuuauaagagggaagcaaagggagauuggcauagaaguagauguguugguggaagcaagagguuggaugcaaggaggggguccggagccagugauacaggcuagacagaagcuagacaaggcaaagaaacaauucugucuuagagaugcucccuuagagacugcagaaggaccuggcccugccaacaccuugacuuuagccaagugaaaccaagaaaauaaauuuguauggguuuaaaccacccaguuuguggugauuugugggagccauaggaaacaaauacauauggugugugaacuauguaucaguaaaucuguuacaaauguugaauguaaaauaacaggcaaaaguuugucagaaaaaugccuacaaaaauaaaucauggaucacggcauuaauaucagacaaagccuaauugucaaggcaaaaaaguauuaacuggcaaccaggggucauuuaauauugauaagaaguauuuauuuauuaauuuauuuauuuagagacaaggucgcacucaguugcccaccuuagaguguaguggcacaaucucagcucacugcaaucuccuccucuuggguucaagcgauccucccgccucagccuccugaguagcuggaacuauaggcaggugccgccacacccagcuaagauaagaaguacauauuuaucaugaaccuuuauauucuucaaguaacuuuaaagcaaaacauggggucagguacaguggcucaugccuguaaucccagcacuuggaaggcugaggugggaggauugcuugaggccaagaguucaagacaagccugggcaacauagugggaccucaucucuacaaaaaaaaaaaaagccaggcauacuggcccacaucuguacucccagcuacuugggaggcugaggcaggaggauugcuugagcccaggagaucaaggcuacagugagccauaaugaugccacugcacuccagccugggugacagagugagacccugucucaaucaguuagucagucaaccagacauauauacauacccaagcauguagaucaaaaaguuagaaauguaaggaaaaaagauaguuaaaacccaccaugggggggcaugguggcacauauguauaaucccagcacuuugggagcugaggugggaggauugguugaggccaggaguuugagaccagcccaggcaacauaaugagacuucaucucuacaaaaaauuuaaaaauuagccagaugugguagcacaugcuuauaaucuuagcuucuugggaggcugagaugugaagauugcuugagcccagaggucaagucugcagugagcugugauugcaccacugcacucuagccuggaugacagagcaagacccugucccaaaggaaaaaaaaaacaaaacaaaaaaaccccgcaaugauaguaagaggauuuacuauccuugccagaucaacaaagcaaaauauaaacaagaauauagagaucugaauaacagauuuaauaagguugacagucuaggcaacauagugagacccugucucugcaaaaaaauguaaaaaaaaaaaaaaaaaaaaaaggaucugggugugguggugugcacuuguaaucccagcuauuugagaugcugaggcaggaggauuacuugagccuaggaguucaaggaugcagugaacuaugauuauuccacugugcuccagccugggugacagagugagacaauggcccaaaaaacaaacaaaagaagcugauacaauagauacaggagcauugacaccuuacaaggggauaaauauaucauauuugaaaaauuacauaaauggauuauaagaauugaccauuuauuacuaccaggccucaaauaauuuuuuuuuugaaacaagaucuuguucuguugcccaggcuggagugcaguggugcagucucagcucacugcaaccucugccucaccaguucaaacaguucuccugccucagccuccugaguagcuggcuaauuuuuauauuuuuaguacagacaggguuucaccauguuggccgggcuggucuugaacuccugaccucaagugauuugccugccuuggccucccaaagcguugggauuauaggugugagccaccagcccuggccccagagaauauuuucugaucauaguacagaaaauucagaauuuuagaauuucaaaagacaagaaaaaaauuucaaucauguggagagugugugugugugugugugugugugugugugugagagagagagagagagagagagagaaagagagagacuugcucuauugcccaggcuagagugcaauggugcgaucucagcuaacugcaaccucugcuuccuguguucaagugauucucccugcuucagccuccugaguagcugggauuacaggugcgugccaccaugcccggcuauuuuuuauguuuuuacuagagacgggguuucaccauguuggccaggcuggucucaaacuccagaccucagguaauccaccugccucggcuucccaaagugcugcgauuacaggcaugagccaccacaacuggccggaauuuuuuuuuuuuuuuuuuugagauggagucucacucuaucacccaggcuagagugcaguggugcgaucucggcucacugcagccuuugccucccagguucaagcaauucucugccucagccuccgaguaguugggauuacaggcuccugccaccaugcccggcuaauuuuuguauuuuuacuagagaggaggcuucaccauguuggccaggcuggucuugaacuccuaaccucaggugauccuccugccucagccucccaaagugcugggauuacaggcgugagccaccccuccuggcuggaaauuuuuaaaagaaaaucuuaauuuacagguuauuuagaaacaaaaaugauaaccaaaaauaaaaacuuagaagguauuaucuaaacugguauucaaaggaauauucauugucuuauuuucaaaaaaauuuauaugagaaaguuggaaaagaaagaaacuccaucuagcuaaagaagguagaaagagaauaauaaaauaagucuaagaaaaaauagaauaaauaaacgugaaagaaaugaaugaguuagcgaacagggaaaaguagacuuguuaaauucaagaauugguucuauaaaaagucugauaaaacagaaaaacugcuacaugcuaaugaggaaaagggagaagaaaacuaauacguagcuuuagaaacaagauagcuguaauugcagacaagaagagauugaaaauuguaagaaaaggcuauguauuaguucuguucuugcaaguuaaaaucucagccaaguggauuaacuuaguaagaaaauaaaauaaccaaaacacauccaaaccucagaauaaauauuaaccgaaaaccucaauagaguaauaaacauauacaaaauuggaaaagugauuaaagaacuacaucccucaaagagacccuaggccccaauuauuuugguugacuucuguuaaacauuuaagguacaaauaauucccuaaucuuauacccuagucuuauuauagucauuuaucauuaauaaucaaauuuugauuuucauuucccuaaugauuaaugauaaauaaucauugucuuuagggcaaugaagaaccgugggaguugcaugcaauguggaagauauguggaaaguaguauagugaaagccccguugcucauguauuuacuucgucaacauauaacuauuuaacacuauuggauacaagguaugagauaaggauuccaucugaguccuuugggguuucaggguucaaaacugggaaucccaaaggacuaaggggaaaugagagcccugaacugaggcaggagaacaaaggaggcagacacuggggcuggagagacaauaggaugaagucaacauaacuucaggggccacagccugcagccuggcuggaagccagaugugcuucacagucacaggucugagggcagcagcucuuuguuacauaccucagaugauaauguguuuuuagucucauaggagcuuguagaaaauuuaaaaaaaaauuuuuuuuaugagaccuucccaaagacucuuccuuuauccaguuaagcuucaggaauacaaaaaaauuaugguaucuugucugggacuauuuuugcaacccaacugaaggcccagugaccuuauagcaaacauuuugaaaauuagccaagugugguggcacacaccugugaucccagcuacuugggaggcugaggugggaggaucacuggagcucaggaauucgaggcugcagugaacaaaccugcgugacagagcaagaccuuguuucaaagaacaaaacaaaauaaaacucuaauggcuccugcaaauacccuaaacacccuccaucucugguaauuauaaaauguuuguuaauguguuaccuguauauguauauuuaaaauauuuuauauuucagccugggcaacauguaagacccugucucauucaaguguguguguguguguguguguguguguguguguguguguguguguguaugaaaaauaagcaaaagaccuggucccuaugcucagcaaugucaugcacugguuguguauaguguauucuggaaauaacaguauaagugacacauguuuauuugugucaguaggaauuuaaaggaggaagagaauuauggcaaggauacuugggaaguuuuuucagagcaagugggaauugaauugggccuagaaaaauggaaaauauuuggauaagaagcagauuuaugugguggcucaugucuguaaucccagcacuuugggaggucuaggugggcagaucacuugaggucaggaguuugagaccagccugguugaaacccugucuguacuaaaaaugcaaaaaaauagccgggcaugguggcaggcaccuguaauccuggcuacucaggaggcugaggcaggagaaucucuugaacccaggagauggagguggcagugagccgagaucacaccacugcacuccagccuaggcaacagaguaggacuguaucucaaaaaaaaaaaaaaaaaaaaggucuuuagaaguuucaaagaagagaacuugcuagaugccaaggugagcgacgagguugggcagcuaaagaaggaagaaggugagcaaaguugcucaguauaggacuccauggagguuguaugcugggagcucaagaggugucauucacauagucuccaggguuaggcaggcacaacuuuaucuggaggcucuggcaaaggaguauuggaaaaauaaauaauuggaaagauugaaaugcuggccagagaaacuuggacuuuguccuauaagaagugaggaacuauagcaguuucuugagaaaaaaagauaaaugauagugauguggcuaaauauaccagcuuuagagcuacauaaaaauuuguuugauuuuuggcuacacuucuuacuaguuaauaugauuuggagaaaguuacuuaaguuuauuaagccucaguuuucuuauuugcaaaaugaacauaauauuuuccuuauagaauuaugguaaggauuauuugagacaacacauguagugcuuggcacaaaguaagugcucaauaaacgguguuugaugacaauaaguguuuccaaaauuucaaauggcagugguauacaagaugaauugaggcaagagaaugguaacugauuuugauuuaagugguuguuuaccuuaguugugcaaccaauugacauguugguaugaagugacaaaggcguaagcuaugguuuuuggaauaggaggcauaaguuggaacacaaaccuguauuuuaucucaucugugacaccauugauuauaagaugugcuguuauuuguguacuaugaagaaagaaaaaacauugauaaauguugacacaaugcuaucacuuagaauuuuuauuuucuacuuauugaaagagcucuuucaaggcuuagacauagcuuuuaaucauauaucauuuuuguauacauauauaaaaaggaaaauguaagugaaauaagguauuccuaaaacuucuucacauucagaguccaacccuuuugaauuacuucuuguuucagucaucauugucuguguuuuuucauguaauauuguccucugugccaucaugaaaacaggcaaugcuauauuucuuuaaaaagugcucuguuauugucugaauuuuugcccccaagcagcaacagguuugaugcaaguccuuuuuuuuuuuuuuuugaggcggagucucacccuguugcccaggcuggaguacaauggugcaaaucucagcucacugcaaccuccaccucccggguucaagcaauucuccuaccucagccucccaaguagcugggauuacaggcgcccaccaccacgcccagcuaauuuuuguauuuuuaguauagacaggguuucaccauguuggucaggcuggucucgaacuucugaccucaggugaucugcccgccucggccucccaaagugcugggauuacaggcgugagccaccgugccuggcgaugcuucuugaucuuaacagaaauugucauugggaagguaguagacaacagccaagacucacauucucuucugaaauggugcuaaaugauuuguugaguaaaaaggccagggauagcaaacauguucacauggcugcaggcaaugacagcuaugcccuguuguugccuuguccauagcaauuuuaagauguaucccaauuucagaagacugauaaauaugaaagaaaaaugcaucucagaauugauagaucagauagaauuaaaacaugaggucaguaauucugagaagguuacuuaacuuuaguaagcaagcuuagauagaaaugcuuugguaauaccugaaguuguuuuguugcaaauuacuuagggaugcucuacuagcacuaaaaaacaaacaaacaaaagauguuuuaaaagaauuauauagcacugauaagcugacucauaaaaauggcugaaauuguuugaaacuggcuaauaaagaaguaguaaccuaaugauuuuccauuuuugaaugccagguguuucuaaaagccagaugaaguuuguuuuuauuuuaaaauuauuuauuuuugagacaaggucuggcucugucacccuggcuggaguggcacuaucuuggcucacugcaaccuccaccuccugggcuuaagccauccuccuaccucagccucccgaguagcugggaccacaggugcgcacuaccaugccuggcuaauuuuuguauuuuuaguagacacagggucucaccauguugccuaggcuggucucaaacuccugggcucaagggaucugccugccucaacuucccaaugugcugggauuacaggugugagccacugcacacagccuguuuuucuaauaugaucauucuuccuauuggcuuauaccuaauagaaggauuuaaccuuauaaaccuuaaaguucuaagaccagaagcuagguguauuaguccguuuucacacugcuauaaagaacuaacugugacuggguaauuuauaaauaaaagagguuuaauugacuuacaguuccacauggcuagggaggcuucaggaaacuuaacaaucauggcagaaggggaagcaaggcacgucuuacauaguggcaggagagagacagagagagagacaaagagagacaggugcggagagggaaugccgguggaacugccaaacacuuuuaaaccaucagcucuuaugagaacucacuaucacgagaacaacaugggagaaacugcccccaugauccagucaccucccaccaggucccucccucagaauguaggaauuacaaucaagaugaaauuuggguggggacauagagccaaaccauaucacuaggcuuauaagauucauuugugugugugugugugugaguaggcagcauaaauacuaucuagacuacaggaacauagcagaaaauacaauccuguaaaguugcuguggcaacaucagcugcuuauguugcaauaaauauaauggcaauaauuuuugaaacuuuauuuuuuauuagagaccaggauacaacugaaucucuggaaagauaaugagucuaccaguuugugcuauuuuucucuuauccccuuaguuauugaccuauuuggaggauucuucaacugcagaaguugcaccauguagccaguaauaauauuuauuuuuccagaugcuugggguagaguaugggaauuuuucuuuuuuaauccacauaaugagguauuuauaaggaaguguauagaguccagcccacucagcagacaacccaggauucaaacauugcuggaacuucuagucaaaccucauuuucucuuccauuuguuucccuaaaauagugccuugagcccagaaagcaaguuaauuuccuagcccacuugucacauuuccauaauuccauggcuucuuuguuauucccagagguauccucauaccccuuguguauucuccuaagugaaugaacccauuuuuuccucucccaaguuccaggcauucagaugaacccauuauauuggugguuggaagacccagcgucuguccacccuuucuguucaugaucgaaugugugcauguccaguguguuacuguuaaguugagacauguaacuggcaguagugggaaugcagacaacgaacaacaauaucugguuccaaccugggcuagagcuaaaggcgucauggguuggagguucacuucugucaccaagcccuaccagaagcaagggagauuugaccuauggggcucccuuuggcccgggccuuaccaguaguggcacucagcuacaacauacaccuaucaguuuuuuuucucugauucuuuucaguccagucucuuguaugcuugaaucuccugucuguuugguagucuggcuuugcaggaauguagcagcaguuuugaaugaauugguuacuuuaaguuuuagaaauguaaguccuugaagaucuugaaaaugauuuuggugaugagcugccacagcugguuguucaagcaauggccugggaaaugcagaaccaugaauaccaugccuguuagaccuggaacaggcaauggcacccucauugagaaaaugugauuuugacuaagaagcaguauuucuggaaaauuuuuucacuggcucucuucuauuguuguuaccugcaauuucaucaucuuuucauuuaauuauguucaguaugaugucuuugggaccaguggguauuuuuauuugcuuguagaaguguuuguuuuuaaggcuaugcaauggcucaggaaggccagccccacccacucucuuguugcuuggcaccaauccucccugguuguugggcaucuuguuuacuucugcccuuaauucccugcaggugcguaaguacaagagcaugauccuggaagaccuggagucugcucuggcagaacacgccccugcgccacaggagguuaacucagaacugccgccucucaccaucgacggaauuccagucucuguggacaaaaugacccaggugaggggugggaggugaggaggagacucaaagacaaguggcacaggugugggcgggccucugaucacuuuucugcauuuuguccucagugaucugaccagggagugagaugcugacuggagucuuguagugaaacaguagcagccuuggaaaagacauuauagugccagaaaagugcucccaaccaagggcauggcuguggucuccucuuucuucuggcaguuuuuuuuucccuuucacuugggccuuuggguuggauuuaaaaaaaaacaaaaaaacuuuuagcuugggguuggucugaacaaaagaacauuaggaguuuaaugaaucacagucaagguagccaaguaaacuuuuagcccucgggcugcucugcuccucuuucaauguaaauucuaaauacuuccauaauuauuacuaaguacagcuuccuuccgcaagaauguaaaagucagagugacagucuucugagucguugauuuccucuuccuuuuuaaaauuuuuauuuaaauuuuacgauuucuaaagaugagggucucacuguguugcccaggcugaucucaaacuccuaggcucaagcgauccuccugccucagccucccaaagugcugggauuacaggcaugagccacugugccagccugauuuccucuuccuuuaagaagggaagucaaaaauguacuuagcaugauaaaucagcauaccuuaguaauuuuuaugaaauuauccccuuuauauauuuuuaguuuagcuucaucaaaaucaaacaccuuuuuaacauauuuucccacccuauuuauuuauuuauuauuauuauuauuuuuuuuuuuuuuugagacagagucucgagcuguggcccaggcuggagggcaguggugugaucuuggcucacugcaaccuccgccuccuggguucaagcgcuacucgugccuccgaauagcugugauuauaggugcgggcuaccacaccuggcuaauuuuuguuuuuuuaguagagaugggguuuugcuguguuagccaggaucgucucaaacuccugaccucaugugauccgccugccucggccucccaaagugcugggauuacaggcgugagccaccacacccagcccacccuauuucuuuauuaauuuacuucuaucuugcuaaauccacuugucagguuuuuuuccuuaucuuauucagucuucagcagcauuugacauaguugauuacuccuuaaagcaucuucucucugucucuugaccacacccucuucugaagauccucauccuucacuaggugcuccccucaucccuucuggggccccucuuccucuucuuaccugaucaucgauaugcuguuuucacccaguuuacccucacuguuagaugucugguccucacacgccccaaacagaaccuuugguuguuccuacucuccacuccacaucuguuccucuccaggcguuccccauaucaguuaaucgaacuacuguccaucugguugcucaagucccaguauagaaguaauccugauuuccuuguuuugcccucucccuccacauuccccugccacccucccgguggcaggucaugucaguucaccucugaaauguacccugacucuggccauucuucucacuucccaucagcacccaaguccaagccuuuagcaucucucauauagccuauccacuguggucugcugcaguccauucuccauguagccaucauaguaguuuuuuaaaaaacuuaaaucaugccggacguuguagcucaugccuguaaucaagaggaggaucccuugaguccaggaguucgauaucagccugggcagcaggcugguauuuuuuuugucucuacaaaaaauacaaaaauuagcuggggccauggugguguaugcauguagucucaaauacuuggaaggcugaggugggaggaucguuugagccccagagguugaggcugcagugagccgagauugugccacugcacuccagccuaggugacagagcgagauccugccucaaauaaaugagugaauaaugaaugaaugaaugaauaaauuuauuuauuuauuuaauucaggccauaucacuuccuuguuuaagcccuguaaugguuuuccacuauuccuagaaucaaauucagacucugccauggcuuugaaggcccuauguaaucugaccucuuccugccucaucaucuuccccucagucacugggcugcggccacuguagcccucuuuuccucaaacacccugcauccguuauuuugcuuuugcuguucccuuugccugaguauuguucucccagaugauugcaugauggacuuuaucuuauucaaagucuagcucaaauaucaccucugagacaagccuuucuugauuaucccaccuaaaugaagcuuucuucucccuaccaagccacuaauacauccucuguguucuugucuguauaacacuuguuacuaccuggaauugucucauuuauuaacuuguauacuuauuuguggucuccccagcuagaauuucaggaauuuaguuucuguccuuuacuucuguucaguauagcugcucagcuucugaaauaacauguuaucuaaauaauaguaucuguucaguaaaugacuucagaguuagagcaaaaaugaguuaagcgcagugguggggaacaggaucgcaaguccccugggcaguuguuuacucaguguggacgcugacgcugcugcucagggguggcacuuuuauuuuuuauuccaucugaaccagcaacuuggucugaaguaauacuauauuuuauaaauauaaaccuaaauagugaucuuuugauuguuggauucauagcccuuucuguggacacuggaaggaucucuaaauagugguucagaaaggaaagcauaucuaaaccaagcuuguccaacccacgucccgcaagacgcaugugacccagaauggcuuugaauguggcccaacacaaauucguaaacuuucuuaaaacauuaugagauuuuuuggcguuuuuuuuuucuucagcucauuggcuguuauuaauguuaguguauuuuauguguggcccaagauaauucuuccucuaauguggccuagggaagccaaaagauuggacaccccgaucuaaacuuuucuuuacugucuuuuuacaguuucuauuauucuguuucuagaggcauucugacugguucaaguaaagaaaacauaaagugaauuauuuuuaucuaguugaugugaagaaucuacucugucucagauguaaaguacaucuacugccuaagccuuugguuucuaauacuguguuagguaaacuccucuccugugauggguauuuuuuguucuuugucacauuugguguguuaggguaaagcagucugagguuuugauuauauuauaucaucguggauuggccacaaaagucagcaaacaguuuaguuauuaucauuuuggagguaagacauuugaaaguguuguuuuccauauuugucaaaaccacacucaguagagcuuggugugcuggugaaugaggagcuggaucucaguugucaaacucauagauacuuuguuggaggugcacauuuucucuaucauaugcucccucuuuccccuucuuaccaaagaugaugacuaaaaagucaaccauaacaaauaaaauaaaacaaacaaaugaggaggaagagggagcaggaugaugaaaaacccagcucccaauugaaugggaauuuccaaguauuuggauccuggcauuuuccccccucaacguuuuauuguuguuuguuuucauugaauacuuuuuucuuaacuugagcuaaauagcuccucuuugucucugucucucuuuuuuuuuggggauggagucucacucuguugcccaggcuggagugcaauggcacgaucucggcucacugcaaccuccgccuuccagauugaggcaauucucccaccucagccuccugaguagcugggacuacaggcaugcgccaccaugccuggcuaauuuuuuuuggauuuuuaguagagacaggguuucaccacguugaccagacugcucuugaacuccugaccuugagugauucucccaucuuggccucccaaagugcugggauugcaggcacgagccacugcgcccagccaauagcucucuuuuauaauugauccuaaagacuuucacuauuaaugggaguaaaaggaggguuuuauuuccacccaaaccuagauagacaaggguaugggacugcaagcaguuuaauacacuguuagugagaaugcagauugguacacuuucucuagauggcagguuggcaaugcauaucaaagucuaaaagguguguaucaugcccuccaguuaaacacagauguacauuguuuauuacagcaugcuuacaauaggaaaauugggaacaaugugauugguuaaauuaugaugguguuuagaauuuauauaggaagacgagcagcauagcccaaaagagaugauuccgugaacuguuagacacuaaaaaugaugauuugcucuuuauugcagugaauuauauuugugguauguuaaauuaaaaaacugauuguaaaguagcauuuuuuauauacuguaauuugaggaguuuagggcuuuauuuuucuguuucuuuugggagauuuaaaaaaaauucugggaacacagaauugagcugauuuaucucauuuucuauaacauuaacauaaaacaugcccaccucuguguguauagaacuuuggagggaugcacauuaaaaucuuaacacugccgggcaugguggcucacuccuguaaucacagcacuuugagaggcugagguggguggaucaccugaggucaggaguucgagagcagccuggccaacauggcaaaacccugucucuacuaaaaauacaaaaaucagccaggugugguggcacgccccuguaauccagcuacucgggaggcugaggcagaagaaucgcuucacccugggaggcggagguuacauugagccgagaucaugccacugcacuccagccugggugacagagcaagacucgaucucaaaaaaaaaaaaacaaaaaaaacugauuguaaaguagcauuucuuauauacuguaguuugagggguuuagggcuuuauuuuucucuuucuuuugggagauuuuuuuuuuuuuaaucugggaacacagaauugaucugauuuaucucauuuucuaaaacauuaacauaaaauaugcccaccucuguguguuuagaacuuggagggauguacauuaaaauauuaacacuaauuaucuacacaugguggcauuauaggugauuuucauuuucuuuaucuaaauaagcaugaauugcuuuuauaauagaaauacaaaaaacuauuuuccuauuuuauauuaaacuugaauauuuuaaagugcaaaguuaggccgggcgcaguggcucacaccuguaaucccagcacuuugggaggccgaggcagguggaucaccugaggucaggaguucgagaccagccugaccaacauggauaaaccccgucucuacuaaaaaaaaaaaaaaaaaaaaaaaaaacaaccaaauuagccgggcuuagugguacaugccuguaaucccagcuacucaggaggcugaggcaggagaaucgcuugaacccaggaggcggagguugcagugagccgagaucaugccaucgcacuccagccuggggcaacaagagcgaaacuccgucucaaagaaaauaaaaauaaauaaauaaagugcaaaguuugauaauguuucugcuuuguuuuacgcaaagauuacuuuauguuaacaugaagaugucaacaacucucuuuuuccccccuuauuuuccucuuaaauagauacuguguguuggaaggcacauuacuaaguucuuuacaggggcaucucauuuaauccaccuuucuguguguguguauguguguuguaaaaaauucuuauuuuauagucaaggaagcagagcucagauauagcuuauagccauaaagaacaaguacauuuuacuggacauuaauucuagauuucagaacauguggguaauuuauggcuuccuugaagugauaaaauucuagaacuaucaaauuggacuguaauagagauagacuuggguuaaccagacaacucuauuaaucaucuuaucugcacuuaaugguauagagauaacuugauauugaugacccuaacuuagaaaucuauauaggauccuaagauacauucugaaucaucuaaagagaguaaauuauauucaauauuguucuaauauuauguguugcacuauuuuguaucuuuauaaaugagaagguuagcaugauuuauuggaaagaauacuaacucagagugagaagaucuauucucuagucucaauucuacuacauauaaccaugguucucacuuucaucuucugaugaaauauaugcccuccuaccuuaaggaguuagaggaagaaaaauaaaauuugguguaggaaaauguuuugaaaacuaaagcaucacaccaagguauuauuacuaauuauuaauguuaauuauauguauugccuauauucauuuuugaauaaccugaacauaccaucucucagccaugcuuuauuagagaaaguucaugaaccaagaauuuuaauuuuucucaacaauuaagugagacaacacagguggcuuuuuuuuucuuuucccuggugucuacgaaaacaaaauauuuuucagauugaaaauugaggcauaaauagccgggcgcgguggcucacgcauguaaucccagcacuuugggaggcugaggugggcagaucaugaggucaggagaucgagaccauccuggcuaacauggugaaaccccgucuccacuaaaaauuuaaaaaaaaaaaucagcccggugugcuggcacaugccuguagucccagcuacuugggagggcgagacaggagaaucgcuugaacccgggaggcggagguugcagugagccgagaucacaccacugcacuccagcuugggcgacagagugagacgcagucucaaaaaaaaaaaaaauugaggcauaaauagaaaaugaaauuuaugaagcaagcuagugacagauagaacuuagggcugcauucauauugccagugcuuuuuaaaaaaucuuuuuuguauaaaacuguauuguguucauuauucagauugacucuuucagcuagucugcacuaaacauuuacuuuuuuuguuuuuguuuuuguuuuugagacagagucucacucuguugcccaggcuggagugaaauggugcgaucucagcucacugcaaccuccaccuccuggguucaagcgauucuccugccucagccuccccaguagcuuggauuacaggcggacgccaccacgcuagguuaauuuuuuguauuuuuaguagagaagggguuucaccaugucaggcuggucucgaacugcugagcucaggcaaucugccggucuuggccuuccaaaguuuuaggauuacaggugugagccacugcacccagccaacauuuacuuuuuaaaagaauuuuuuacuugccccaaaacucucaaacuugucuccuacacauauaaaaauuguacauagcaaugucugcaguucugugagaacuaaaugcucuguucuuuuaggaagcagcucucuugguuuuugucuuuugucuuuuuuguuuuguugaaagcaugauucuuuauuaguaaauaggauguuuuaccuggaaaguuucuguuuuuauuauuauaacuauauuaaaguuuuuagucucuucuuuuggugccaugacuuggauuauaguccucauuuuggcagggggguggggggugggucugcacguuagaaaacuacauagcucuaugauauuuuuaguuauuaaaaugaaaauuuggauuucuaggcaccuuuaagaauaguggcuggaacuuauucuauacuuacuccauaucuauuuuagaauuggaggagguugagauaaagcuuagcaaaagggauccuuaguuugggguagguucuguaaccccagaauucauuuacaaugaagucuccuuuuucagauuuugaaagucagguuaguaaauuucuuuuaggauacuacagaccagggccuaguggaugggcuaagucaguuccucucaaacuucagagugugcagcagucaccugagaagugguguucaaaugcagauuaggaaucaguaggucuggaaugggccugagguucugccuugcuggugagcccccaggugaugccaaugcugcuguuucucagacuaugcuuugaauucaaggaauugcauagcuucuugcagagucuuuaagcaauaauuaugauuuugcuaguggaaaaucaguucugcucuuuaccagacuuggguccuguaggcaucucuuguucuugggaggugguaaaucucuuuggaaucuguauuagaagacauccaggcaaagauauaauuauagaagaaucaucacuggaaagaccugggcgguauuauugauuaaaauccacucuucuuucccuucucccuucccucaccuuccuugaacuuacugcccuccucuuacugucauuggggcaaucuuuguugcuuuaauauucccguggcaugaugaugcaacaggauaguaauuuacagcaguuucagguaaaccuucugaaauguucagcagagugguugcuucauuaggaaggaguuauucacacggcuuuugagauguuuuacuuacaaaacagucagucaguuaucugcuuagguuuuuugagaguuuuguucuguuuugaaaaaacauuggucucaccucuucuacccaaagaguagaaaacauuaugcuaagugaaauaagccagacacagaaggaaaauauuggguuucuagaguuggcaaaaugauaaagauagaaaauagaaguggcugggcaugauggcucaugccuguaauaccaacacuuuagaaggccaaggcaagcggaucacuugaggucuggaguuugagaccagccucaucaacauggugaaaccccgucucuacuaaaaauuuuuuuguauuauuuacaaaaaaauuagccagguaugauggcaggugccugcaauccuagcuacuggggacgcugaggcaggagaauagcuugaacccaggagguaaagguuguagugagccgagaucgcgccacugcacuccagccugggugacagagagagacuccaucucaaaaaaaaagaaaaaaaaagaaagaaaauauaaguuaccagggaccauggggagguagaagucaggaguuaucguuuuaaugggcacagaauuuguuugagaugauaauuuuaaaguucuagaaauaggccgggcgcaguggcucaugccuguaaucccagcacuuugggaggccaaggcgggcagaucacgaggucaggaguuugagaccagccugaccaacauagugaaaccccgucuccacuaaaaaaaaaaaaaaauuuagccgggcaugguggcaggugucuguaaucccagcuacucgggaggcuggggcaggagaaucgcuugaaccuaggagguggagguugcagugagcugagauggcaccauugcacuccagccugagagacagugugagacuccaucucaaaaaaaaaaaaguccuagaaauaauuaugaugguuauacaacauugugaacauauuuagugccacuaaaugguacauguuaaaaugauaauguuauguuauguguauuuugccauuauuuuacaaaauuuuuuugaaaagggcuggauaaaaaguauuuuaguuuggugguucucaaaauuggcugcauaguagagucaccuagggaacuuaaaauccuagugccccggccacacuccagaccaauuaagucauagucuucagggauggaucuaggcaucugcaauguuuaaacucuccaagugauuccagcaugcaggcaacuuugagaaccacuaugauggaucacaauuccaaacugcuucuccauacuguagugucagaauuuacuggcaaagcaggcucuucuuacugucugaaauuaucaaaaaauguuuacauauaugaugucuuuccauguuuaguaggcauaaugaaauuaagagaauauauaugggccagaugugguggcccaugccuguaaucccagcacuuugggaggucgagguaggcggaugguuugaggccaggaguuuugagacaaccugggcaacacagcaagaccucaucucuacuaaaaauuuaaaaauuagccaggcaugguggugcauccauagucccaccuacucaggaggcugaggugguaggaucacuugagcccaggaguucaaggcugcagugagccaugaucaugccacuguacuucagccugagcaaaagagcgagacccugucucaaaaaagaaaggaaaagaaagagagaauauauacguaacaaauaaaaacacuggauguguucuuaaauagaacauggcauauugugaguaaagaauaaggguauauucagaaauacuaaagagaagaaaauagccauauaaauuacuuacauaggauacaacuugacuaaggaaauauuuacauuuauaugacaauuaauauccagagcagauuaauauuuucuucauauucauaagaaaaagauaauuagaaaaauaagcaaacauuauaagcaguucacagaaaggaaaaauaaccaguaaauauauaaaaagauugucaacucacuaguaauggaaauuaaaauaagaaaacauuucccccauaucagaugagccaaaauaagaaaacuugauaauaaggcugggugcaguggcucaugccuguaucccagcacuuugggaggcugagguggguggaucacuugaggucaggaguucaagaccagccuggccaacauggugaaaccccgucucuacuaaaaauacaaaacaauuagccggccaugguaacgcaugccuguagucccaacuacagguugaggcaggagaaucacuugaacccgggagguggagguugcagugagccgagaccacaccacugcacuccagccugggugaugagugaggcugucucaaaaaaaaaaaagaaaaagaaaaaaaaaagagagaaaacuugguaauaaaauguggaagaggaugaauggguauugucugguacucuuagugacagugggauuggcaaagucuuucuggaggacaauuuggcaguguguuaaaauguuaaauccauauacccuuuaaucagcaauuccacuuuucugaauuucugcuaaacugauuucauaaacuguaagcaaucuaaauguuuaucaguaggggaauggcuaaauaaaauggaaauucuauaccauggauacuaggcaacuguuuuuaaaaauuagauuauucuaguugcacuaccaugagaagaucucuaugacaaaauguugaguggaaaaaacaaguuauaaaauaguguacaauaugguaccauuuguguuuuucuuuaaucacauaaaacugccuuucuagcauguauuuauguaaauguauagaauuuggccuagaaggaaggcuguucaucaagcccaugccucuggauaggagacuggauugagggaggauacauggcaaagaggacuuugacuuuaucuauauuauuuacauuuuuguacagaagaguacaacaagcauaagguaacagaaacuaaccaaacugucuccuucaaagagaagguaggacuuuaagagcauuuugauuaaaaagagagagaaaguuugauagguugggggugccgagauacagaagcagaagucuugccuugagagaggagucuaaaugagugucuccauugacuggccuucaaauucacuaauucugaaguuacguugaucuuuucuccaaacuugcucuugugguuucuaugggaauguguuuuuagggaaaaugagauuaagagaagccaguguuuugcuuggcacuacuagggagugguguuucugauaauaaccaccauagucaucucucugaacagagaucaguacuacaaauaauucccaauauagggcaaaugaaucacuuugcuuuagcucuuuaaugcccuuuaaauauccauucaaauaaaauugggucugucagccuggacgguaauaauuuuaaguuaaaguaauguugccacagucugaaaaaucuccauuuuuccuucccugcuacauuccuguuuucuguaggcuauacaaacauaaccuuucaacaugguuugcuuucaacugccuucucuuuaaauuuauuauguauucucugaccucuucaguagagguggaguuggcagauauguuggucugaaagaccuuuucuugguaauugagccuaaauggacaucaggagccucaaaaucccuagacucagauaaaugcagagcaaagauagagggaacaagaggagaggguauuuggaggauguguaaggauaaugcauuguuggauagcaaagaacuaacugaauuuacaaaggaaauuucuagcauagcaagaauuuuuuuuuaauuggauaagacguuuuagaguuuuagagaaccuuuuauuuuaaaccuaucugugguuuccacauaaucuuuacuuuucacugacacaggcaugaauuugauauccuuaucuuugcugauugucccgggaagugguaguauuuucuauucuuugcugauuugguguggcuguacugaccaagcuagaguaccuuaggcccaccuagagcccuaaaucagaaugagaguccaggaaagcuuguuccagcucaauuaaaggacggucugagagguuaggcuuuagcuuugcugauccuguugauugucucccuguguauuaaagacaaaccuuccuuaacaagcacuucaagaagcucugguuuccagaacucuccaggaccaguaauuaauucaacugguaaugagagcacaguuccgaauucuggaaaggaaucauuugacucuuccuguacuggacugcuaguuucccuuuauuaauagucucuuuagccuuagcacuguuuauuugggacaguauaaaaagaaccuguaggaagauugccuuuuucaaugaagucaaauuaucucuuaagcauuuaaaaguaaaaaauacccuucauucccaaaauguacacaccugaaaaacaaacucuuauaguagaaaauaccuuuuacuucuuuugguauaggggcaaauuuuauaugcuugauaauuagcauuuuuaaaagcuaugaucugcuccugaauuagaacuuguaugccagcagcugauuucagucugguuccauuuuuugacuugaugagguuucugccuguggaaguaaccuucuuuuuguacuguuucuguuucuccugccucacauauuagccucuaggaucaucuuccuaggaauuugaaacauuucucauccagagauuucuagcaaauaaaucaucuuugaaaaguuucccaguucugucuuuccucuaauuaugguuacccuuuuuucugacaauuuccauuaguaaucugcuuguacauccccccaccccccguuuuuuuuuaauugaagggagagaaacagugcaugugcgagagggagcugcuuguauuaauacguauuuuuaaugcucaaggaccgagcagaacaaggcaccuaaacuuucuguacauuguggguggguugguaauagcuugccauugaucauugguccaaaugaucaauuuguuccuucuugguucuagcacccuuuauuucucauccucaaccuuguuucagauacauauaaacucauucuucugccgccuucugcuuuuuuccacuuuacccauccuugaaaaacuaaugaugaaugucuuaauguacauuacaguguguucaguauuaguaaaccauuucagaaagcuagcuauuuguuugcauugggagaauaaauucccuauuuucccugauuuaaaaguaaaaucucauuuaccuuugaaauauuuauuuuuggcaaauggucacauuuagacuuugauagaaacuuaauauagauugaguacccccugccugaaauguuugggaccagaaguacguuggauuucauauauuuuuggauuuuuuuaacauuugcauauaccuagugagauaucuuggggauaggaccacaaucuaaacacagaauuuauuuguguuuuauauacaccuuaugcacuauagccuggugguaauuucuuaggguauuuuuaauaauuuugugcaugaaauaaaguuuugacagcgacuugaggucauggguggaauuuuccacaugugacacuugaaacauuccagauuucagaucuucaaauuagggaugcucaaucucuccagauuaaggauuaaaacugugcuggauuaaagccaugauguuucugaguccuuauuuguuuuacauuuagaguaguuuuauuuaauagauuugaagaguggaugcuuaaagcaucuacuuuuuuaaaaaaaaagaaacagcuuuuucuuauuauaaaaucagaauuaccaaucaguugccaaagagcuauggugcaccuaaauuuuauaacaaauuaagcucuaaauuuuagaacaaaaguuaugaauacuggagaaguugcugaaaaaagauggcuugaugacugagguaauaauaauaaaacuucuauuaauuaauauaccugcuaucucagccucuucauugaccuuguauauuugcuauuauuacuguuuugcagaugagaacauuaauauucagagccaacucugagucuuguggguuuuuuuuguuucuugguuuguuuuuuguuuuugagauggagucuugcucuguugcccaggcuggaguguaguugagcgaucguagcucacugcaaccuccgccucccgggauuaagcgauucuccugccucagccuccugaguagcuggcauuacagguaugugccaccaugccuggcuaauuuuuguauuuuuaguaaagacgguguuucaccauguuggccaggugggucucaaauuccugaccucaggcagucugcucuccuugaccuuccagagugcugggauuacaggcgugagccaccaagcccggcccuuguguucuuuuugguagaaagagcuaacuuaagagaagugagucugagugcacugacucacaccugaaaucccagcacuuugggugguugaggcaggaggauugcuucaguccaggaguuggagauuggccugggcaauguagggagaccccuucucuacaaaaagaaaaaaaagaaaagaaggaaaaguaaagaaaaaaaauagcugggcaugguggcaugcgccuuuagucccaacuacugaaggcugaaacaggaggaucccuugagcccuggagguugaggcugcauugaacugugaucaugccacugcacuccagccugggccacagagcaagauccgagagugagagagagagagagagagaaugaaugaauaguuaguauauguuccacaaagaauguaggacuuuucugggcacuaaagaaugaguggcggcauuagaauaguagcauggaaaauaguccagccaggggacagaacaaaggcaaagaagcgggaaugggcuuagcagcucuuaagacagugcagagauuugucugauggaggaccaaggcugaguggugggaauuaaugggaacugacuguagugugaggccagauuguggugggucugaaaagcugggcagaaggaucuaguuuaguugccauaguuaaaagacauuuggagguguuuugagcauuggagcuauguagguaacauuuaggaaaaccucucaggcaaggauaugugggaagagggaaugaagggagaacuuggaguuucccaagaaagccaacuagaaggauacacuagccuugggccaaaaaauuagaauaaagguggggccggagaagaagggauagacaccagagacguuucaaagaaaacaaaagaacuggacuugcaaugugugacuagguaaguguugaaggagaaaaguaaagauaacuuugacauuuuuaguuugaguggccggggaaagggugguuuucuacuugcuaagauaaaaaaguugagaagacaaguagauuggagagaggguaggguaggaguuuaagugaagaggcugaugcugagcccaccuuucaaguaacauugaguuauuggaacucaguuggaaggccuggugggagagccgaaggaagacuugagggugaaagauauccacguccaggugccaacgugacccagaacugaggagcauaaggaacuauuggugcaaauagggugaggcgucagaagugaagcgaucaccagaauuagggaauauagaggguuccagguggaucugagcagacucugucagucuaguauucuccacagugagugcuuucugaucacuuuaggauuucuguuuuguuuguuugguuuaagacagggucuugcucugucacccgcuuuaggauuuuuguuuuguuuuguuuuguuuuguuuugagacaaggucucacucugucacccaggcuggagugaaguggcaccaucauggcucacugcauccuugaccuccugagcucaagcgauccuccugccucagccucucuaguagcugggacuacaggcacgugccacuguaaccgacugaguuuuguauuuuugguagagacagagucccacuguguugcccaagcuggucucaaacuccuggucucaagcauucugccugccugagccucccaaggugcagggauuauaggcaugagccacugcacccaacccacuuuaggauuuuguuaauuuagaauuauuuagccuucucauuucauuuucuccagacucuccuagguaugaauauaaagaauucuccuuuuuggaaacuguuaaugguauucaaagaaaagggaguuuaugaaagucuauaucaauuuaaucuauaccucugagaaagccauuuuuuuuaacaugaagaaguauaaaauauugugugugaagauuaagcccuuucuugcucuauguauuugagccuagaaaaagacacacucccaagaaauuagaauaaagggaaaaaugacuuugagauguacuuucuuaaaauaacugaaguaaugaccgcaugagccagcugauggguuuuuaaauggauacguuucuaucagccugcugcuugaugccagagccaaauauauauggaguguauuauaucauauccuguaggcaggagacuguuggggcauugggggacuuagagaggugaaguggcaggcuuggcacaggaauuaacagcauggcuaccgucaaccagaacuuuauuaggucaacauuacugauuggguucaugguucccuauuauguaacaauuuguaucaucuucucguaaaauaauaucuaauauuuauuauaagaaugauaagaauaccugauauuuauagaaaucuuuaauauuaaaguguugcuguacucauucucucauuaauacuuaauuauucucauuucuguuuuuucuuguuuuacuuuguaacuacaaauccacacccccgagucugauucauugcuaaaaguggccucuuuuugguuuucagcugcaggggcaguaugggugcauccuuaguugcaggaugcuacuuauaucuggagugcuauagaccaccagguuaaaaggaagacaguaggucugggaaggaggaauagaucauaaauugauaaacugcuuuucuugccagaaaucauuaucagcgauuaagaauauucacaaaguagacccucccccaacacacacagagugugguuacuaugccaggaaauaagaauggcaguugucuuugugguuuaaaaccuguuuggucuggauuugauuuguaaaauaaaucugaaugaaguccauaaugcauuuaaauucacacaugcuuuacuaugucuauaugucagacucauggacaguggccuagcuuacuggaaaauuucuagaagaguuuuaggguuauuuucccuuuuuauuaaguuaaaggccuguuuguuuuccuauauuuuauaaucagccaccuuauugaauucucauuauuguuuguaguaguuuuucauuugaucucuuuggaauucucuagauauaaggugacuucaucuauaaauaauaaugauuuuaucagcucgccucuuauuucucucuuaucuaauugcauggauuccuacuuccagaacaguguugaaaacaccccgaguuuggcaccuuacaugcaugaaaacuguagaagggaaauaagcuauaguaccaguaauaucuugggaagcagaaauuaaacuuagggguagauauucuuacucuuagaggaacaagucuacaaaaugcagccuaaggugcacuuuaucaacauauuuauaauucucaaccacccauggagauauaggaaccuauggaaaacaguggguuuucaucagucacaucuuagaauucucugggaccuuccuggaaaccucucuguuuuauaagguuagaauuuaaggagucauaaacacaccccagaugucuuucaugaguauugaugaccacacuguucucuuccaggcccagcuucgggcauuuaucccagagaugcucaaguacucuacaggucggggaaaaccaggcugggggaaagaaagcugcaagcccaucugguggccugaagauauccccugggcaaauguccggagugauguccgcacagaagagcaaaagcagagggugagaguuccucugacugaguugccugguugcuuuuccauccuaaauuaaccaccucaauuuuugucauuucuacaucuugugcuagaaagucuuuguguaauaguuaagccugucccuccaaagacugauauucuuugauuuauagccuuuuccauuugucgcuccaucacuauacuauaaagagaagacuggguugaguugaugaauuuaaaaugugucuucgggguugccuuuuggagcaguuuuaauuuuaugaagugcuugggaaagucaaagaaacuugaaguaaaaguauuaaucacuuugaacacuuagaaaugcuuuuauuucugguuacuaaaaaucauuguugaaaauguaaauauggaauuagagggauaugaagucugccagcugagucugcuaauaacaaaacuuuuacaagaaagacuaaacuaccuaccauuccuuacuuuuuuugcguauuuauuuuucuuuuucuuucuuuucuuucuuuuuuuuuuuuuuuuuugagacagagucucacucuuguugcccaggcuggagugcaaugacgugaccucggcucgccgcaaccucugccucccggguucaagcaauucuucugucucagccucccgaguaguugggauuacaggcaugcaccaccaugcccagcuaauuuuguauuuucaguagagaugggguuucuccaugcuggucaggcuggucucgaacucccgaccucaggccauccgcccuccucagccucccaaagugcugggauuacaggcgugagccaccaugccuggccacguauuuauuuuucauuuagcuuggaaguuuacugagaaucuuaauaugccauucuugaucagaauaaucuuucuuugcaagaaguuuaagaguuuggccucagguuggaauaggguguaaacuagacuuugaucaagaagaaaccaaugagaagcccucuuugauacuucguacacagcuucuuucuaccagaaccagucugugggagguaauccuaggagagucuaauaagagguuugguuugguuugauuugauaaagaaguagcugcuuauugcauauugggacuaaauaaccaaaguucuuuguggcuuaaugugcuuuuccggucauuuggugacagguuucauggacccaggcacuacggaccauaguuaaaaacuguuauaaacagcaugggcgggaagaccuuuuguaugccuuugaagaucagcaaacgcaaacacaggccacagccacacauaguauagcucaucuuguaccaucacagacuguaguccagacuuuuaguaacccugauggcacugucucacuuauccaggugaguaaaccugagggcuaccagacuguggcuucugagauggaucagugggcaccucaccucagacuagggaaaguuuccuuugugcgaacucuuguaugaacuuuauauagcuccccaagaucuuccuaccugaaauugauuucugaagaauaguuuaaauucuuugcauuugcuaaauacagagcuaugaguagcuuccuggacauuuccaaaacaaagcacuuuuaaagggcucuuuuuuuuuuugagacaagaucucucucugucaucacagcucacugcagccucaaccucccgggcucaagugauucucccuccucagccucccgaguagcugggacuacagguguaugccaccaggccuggcugaauuuuuuuuuuuuuuuuaaguagagaugaggucuugcuauguugcccaggcuggucucaaacuccugagcucaagugauccuccugccucggccuccuaaaaugcugggauuacagaugugggccaccaugucuggccuuaaaaugacuucuguuuuacaguuucacucucagugaucagggaauauuccuucugaaugaccucuucugagguaaaacacaauuuguugauugggaaccucuaaaguucagauugaggugagaauagaaaguugguugaccaacacugggcauggauguggcgaugugauagcuuuucucauauggacuuauuugguugaaguaaaauucugaaacucgugauagucucugaacuaugauuuuagugagcuaugauuuuagauuucacaucauaaggcauauucuuuguuaucugugcugaauuugggauuaaaugagucucagcuucugaguaaagagguggaaggauccauccacugacacuuaaccacuuuccauauuuuucuuuagguugguacgggggcaacaguagccacauuggcugaugcuucagaauugccaaccacggucaccguugcccaagugaauuauucugccguggcugauggagagguaagaaagagauuccaucugcaucuucuuaaauacuugaauguauaaugagggaaaagcaaggguccagaagauggaguagccugcaugucugcggcacucuuucauuuaaaccuuuuaaagagcaugagaccaugaaaguuuuagaaagugucuuaugcuauguguauuaauuguaacaauuaagauucauggauuaguaugucaggaacuuagaauuuuacauuugaauguauagcauuugguauuauacacaauacaaagggauuaucccuuuaccauuuuuaugcugugaaucccaaagaauuucaucuuuggucuuuaugaaaaaaaaaugucacauuaaaacuggaacugacuaagggaagccuucuuugaaaggauaaauauguuugcaagucaguaacaugauuuauuacaucuuaaauaugccuuugaaaagauuucuuaggagaauucuuccuuaccaaaauugggauaauuaugggacauuaaccuaaagacagccaaccuuuauugaucacuuggugggcuaaacacucaacccuaugaaguauaaaguucuguuaucuucacuuuagagaugagaaaaccgagacauaacagagcuuagaugauuugcccaaagucccauagcaguguugaagcuggauaaugcauugagaaaaacauuaccuaggcucugagccauuggugaagaugcaacagugaaggaagggguuuguuacgucaccaugaguguuucccuugaagauacugauguggugugcugaaguuugaaaaauagccaacagaugucaaagagcaguaucagaaauaaagcuaagaguauuaucucacccuuguugagagccauggagcauuuccccuuagaacaccacaaagucacuuucauuugugccccucaggagagggggagagcuggcaaaggccacauggcugggagauggagggagagugcaccacaggcuccuuggccacccugcaugugccaaaccccuguguagcugcagcuguguggaguugauucgcacaggauccuugcugucaugggacuccagucuaguggggaagagagaugucuacgugaaugaacucuagccuuccuguaagggaugcugcaaagcguaugugccuccuuuccaccuaaggagccugggaaaguuugggacacugaaaaacuugguuauugggugaggaaaggugaagguugacaggacacuuacuuucuaaguauauaaacaucauuaaaggauauggauuagcaaagcaaagaauuugucagucccagaacacuagaacaagaugacacuccuuaaagucugaaagagguggaaaagacaacgagggguacaguuaggagauguguuaguuuuuggcuuagacaaaguuaucaaccauaugucucuacugaauguuucuugguacuauuuaaagaaaguaacuucguuuccuucuguauaaaauaauuuguuuuugacacauaauauuuauaacauuaauggaguugcguuuccuuuuuuuuuuuuuuuuuuccugagacggaaucucacucuguggcccaggcuggaguguaguggcacgaucucagcucacugcaaccuccgccucccagguucaagcgauucuucugccucagccucccgaguagcaccaggcacgcaccaccaugcccagcuaauuuuuguauuuucaguagaaacgggguuuuaccauguuggccaggauggucucgaucucuugaccucaugauccgccugccuuggccucccaaagugcuaggaugauauauaguauauauaauucuguuagaagagaaagccaaagugcaaaaacauuagagacgugaauuuuaaacugaaccaucaauauauguaacaguuuugaauugcauaacucauuuuaggugcauuuuuaugaaugucaguuuaccuuaaauaugggcaggcugaauaacaaauaggaaaauaucaauaguauuuuuccauccaucccuucaguaaacacuuuuugagcccugugccaggcacuguagagacuauagauaaaagauaauaaagacuccccuuucccuuaaggagcacauagguaggcgguagagaaaagcaaagaacaauugcagugagauaagggucuacuggcagcaagcccagggugcuguggaacagcagaggagaggcucucaucuggacuucaggggaguggaauugucucaggaaacacuucccagagguguagccccugagcuuagacuagagugggaacuagccaaacaaaggagagggaugggaguucuauccugucaaagagagcaacacauucagugcauugacuugugaaagcauggaacagccacaguuugaagggccuugugguagugggccucucucagaaaugcauaguagcuaaugagauaucuucugaauaucuuccucuccuagggcuuguggcccuuucuuuggggaagggagugcaacaagagcucaaguaaacacaguuuaagaaagcacugagacucaggaauaggaaauuccgaagagaugcuggcacuugagcugauuucuugaucaccugccguguuucugauuagaaaucucuucucuguuucuccuccuauuuucucuucaccguuuacugucauuccaugccauauaauuuaacuuucuuaaauuauacuguauauggcagcauucuaaugccauuuucacuacaaauauaguuguaacuaaaaguaucuauauugacuugcugccuuuggaguuugaggacuugagagagccucacugggccaaacucaagugagagcagcagcaugggccagacugaaauagaggggcagaucagaaacaggaagaccauucccuagcaguaggcaacagcacugcccggcuucaguggauguuuugagcggacucaucagccaccuaagaauugauagugcagcuugccucuuaugguggcaguguugguagugauguucauuggagcaaugagaucaaagcaaccaaccuuggaaagcaagagcuuuggaguuccugaggggcaauuuugcagcucuaggauaucucugccucaggagugaugggcccugaaggcuugcuggcacaauccacugcccaugagaacucagggcaaacacgaagguaacucaaaggaaugucucuuucucugagaggcuuuuggcaaacauucugaaaagcauuaucauaaucuaaguaugguaauauaacuaaagcaggaagcauuuaaaauaucuaccuccuagagcuuggagcacuuucuuugggacacaguaacaagcaggcacaagguaacuacucacuaggccccagcaaugugaagcaggaauagcaagagcugcaguaagcacugcuaagguccugagacccaggaguccaaagacagauacaccugagcugauggaucaccugcuguacuuccaaauagaaauugcuuuuacugccccugcugcuuuucaguuuugaggguggguaguuaaucaaccaguauuuauugagcaaaacggacugaaguaacuagauacagguauucagaacuaagucucuaaacacagagaauuguacuaaaaucaguaguucuguaccccagaccagaggggacauuuggcaauaccuggagacauuuuuuaccguccugacuggggagggugcuauuggcaucuagcggguacaagccgggaugcugcuaaccauccugcaaugcacaggacagccccacaaccaaggauaccugggccaaaauguuagcaugccaagacugagagacuguaggccuagcaaaccuggauucucauguauccugucaccagagaguaugauuuuuauuuuuggguuuuuugcugugggcagugggagagucuucauaacuucuccccuacuaaaaagaaagcaguuuuugcuacacuuuaaaaaauuaguuucugaguuuagcaguuucuaucaaaaauaaacaugccaaauaacuuugaucuauaauucuaccucuaggcauuuacccuauaaauagacucacauguaauauacaaaguauaauaguauauaaggauauucaucacagcacuguuuguuaauagcaaaagacuguaaaccacuuaaaugugcaugaaaagaugacuuguuaaauaaaucaugauguuucuauauaaugcaaugcuucccagcacuuugggaggcggaggcagguggaucaccugaagucgggaguucaagaccagcuuaaccaacauggagaaaccccguuucuacuaaaaauacaaaauuagcuggguguggugguggggugccuguaaucccagcuacuugggaggcugaggcaggagaaucgcuugaaccugggaggcggagguugcggugagccgagaucgcgccacugcacuccagccugggcaacaagagcaaaacuccgucuccaacaacaaaaaaaaaaaagccauucuaugcagccauuuuuaagaaucaugaaugaguaaaguaguuuuauauguuccaaaauggaaucauuucagagauguacuguuugugaaaaaagcaagauacaaaagauauguagaauaugcugccauuuuuauuuuagaggagggaguagaaaggggaaauggggugaaugugugugugugucuguguaaauauacuuccauauagcaggaauagcucuacaaagguacacgagaaaauagguacauuacauggaaauauuguauaaugauaaaauaauaaaagagaaaauaggcacaguuguagacccuuuggacaaagggucuagaguacugguaucauauucccuuugauacaguuugaaauuuugguauaguuugaauuuuuuuuuccucucauggcccauuucuaacaacccagccuauauauuuuuaaacuuuauuauguauuuauuuaaauuaacaaaaaauuguauauauuuaucuggcacaacauguuguuuugaaguauguauauaucgggaaguaaauugagaaacguauuuaaaaguguagagugggccgggcguggugacucaugccuguaaucccagcacuuugggagacugaggcagguggauuaccuaaggucaggaguuugagaccagccuggccaacguggugaaaccccaucuuuaccaaaaauacaaaaauuagccagggguggugguacacaccuauagucccaacuacuugggagccugaggcaggagaaucgcucaaccugggauguggagguugcagugagccaagaucgugccauugcacuccggcuugggcgacagagggagacucccucucaaaaaaaaaaaaaagguacaguggaaggucuugcuuucugucucccauccaacuuguuuccaacuccucucaaccccacacauacaauccagagaauauauucaguggcuuuuguguguccuuccagaauuucuucaugcaaaugcaagcaaauucagguauauauucuaauacccccuuuuuuaugcaaaagguagcaugcuuaaagcucuguucuguauauugcaggucauguuaauuuuaaagaguauguguauuuagccaaaaaguagcaauuauuagaaaaauuacuuguaaaauuguacuuuuguggcuuuguuuuuuuacuaucuuguccuuucugccucagguggaacaaaauugggccacguuacagggaggugagaugaccauccagacgacgcaagcaucagaggccacccaggcgguggcaucguuggcagaggccgcaguggcagcuucucaggagaugcagcagggagcuacagucacuauggcgcuuaacaggugguggcaagagugugggaauaagugaggaucgcaaaucugucccugcagauauggguggaggccccuuaaagagaaaugugucucuguuugccacaguuggcaguuggaacuuaacacucuuggcccauacgauauuguaguuuggccuauaauaggucaguccuuaccaagaaaaauuaaacuucuuuccuucaggugugcuuaggaaaggugaugugaaauggaauccuccaguaaaagguaguuuccaaaacucaauguauuguuuccugcuuaguuccuucuacuggcuguugauggaaagaucaucuccgcaucauucuucacuccugccgccacccagccccaacaaccaguguagccuuucugacuuccagcccaagcuggucaagccuucccguuuauccuauucuguguccaguaagcagaagcaguaaggcuugagugcuucauguuuucaagggauacagaacaaauuaagaggcuucggauuauuguccuuuugcccuacaaaagaaacugcauuuuguuggggguauuaauccauguuuaagcagcaaauggcugauuuuacuugcuuuugagaaaaauguguugcccuugcuuaucagcgagcucaagauaaauaaguuuuggauuauuggggaaaauaaugaacuuuuuucuucagguauguuaggaagggugcugccaaaugggaugcuccaagaggugguuucugaaacucgauuguauuauucccugccugguucuuucuacugguuguugacaggaaagaucagcuucauaucauucucccucuucuucauuccugaugcaauuuuauuuuuaaugggcucagggauuuaaauuaauggucaagagugugagccuugacgccagacuacuuggguuugaagcccagcucugucacuuacaagcuguuuggcaucgagcaguugauuugaacucucaguagccaggcucuccuauucuguaaaaugggagugauaacaguacauucuucuaggaguguuaugagaacugaauuacuccaugugaaauccuuaggucagugucuuguauacaguaagggcugaacucuugcggcaugccagcucuacuggguaaggcuguaaauagagaauagagugcucuagcauauacucugcccucaaagaaaucauacucuuauugcggagacugauuuaaguaaaacacuuagcaaacaguauuacuuagaguguaacucacuauugaauuguaugguaaagacugugaacguuguagaaauucagaggagggugaucaccuccccuaaauauaaaaucagugaaaguuuagauugauuaugauagauacuagagagcugugauggauuuguauacaguucacuguaugaggcuguauaguaugguggcugagagcaggguuccaacgucacauagauucagguuugaauccuggcuccaccauuugauccugagaaacauaaccucugagccuuguuuuccccauuguuauaaugaggauaagacucaucacacagaaucauguauaugagauaauauagauaaaauucucaucgcgguguccaaccuauaguuagcauuucaagaauuauaguuauuaucauuuaaguuguauuuuaagaguugucuauucugaauugauuauagugagaggagauuagaagaucaguuaggaagaggcacuccaggagcgccuuguuaaggucuuggaaacugaaguaguaagaauggagguaaagugauucuuuuuuuuuuauuugaaacggauuuucacucuuguugccuaggcugaaguacaauggcauguucucggcucaccacaaccuccgccugccggguucaagugauucuccugccucagccucccaaguagccaggauuacaggcaugcuccaccacacacggcuaaguuuguauuuuuaguacagacaggguuucuccauguuggucaggcuggucucaaacuccuaaccucaggugauccacccgccucagccucccaaagugcugggauuacaggcguaagccaccacgcccagccuaagugauuucauuuuaaaagaaguauggccagagauuggugguugauuaggaauaggaaacugaaacacacacacacacacacacacacacacacacacacacacacacacaacacaucuucucagaguuaccuaguuagucccuagugaucagaacauuuuuuucagcccauugagccauguugcucuuguugcucuucauuucuuuuuuucccccacucacguauauacucaucauguugcuuuucaguaacaugaaagucuuacuugguuccuuacacuuggcucaauucuaccccucucuuugagagaaacacccagauaaacuuccugaaaggcauggccaagugagacccuccgucccuuuaguccaguaacaccccccauucuccgcccgacuguagcuuggggucuaacaggcccucauuaaagaccagcaaaacuugauuucauugagacuugcagccaacaccuuggauauuccagugaaguguguguguccugggaacucuguacauaguggaaaauaugaggcacauuugggcucucuuuguuauaaggaccagggcuuguuucuaaaggcaagcggguaaugguauccccugagggcuuguuaacaaacuuagaugcagcugagguggcucaguguuuacuccaaaggaaggagaauguguucacuguggcauagaggaggaauaaagagauguugaaaucucuuugcaaucagguaguucgaugccccaaugaguguuagggguugguggauugcagcuucugcuggggaugaagaaaccaagccuggcagcagagacuagacuauagcagacuauuaggggaauaucagggcuuucugaacccaacagagguaacccauggucuaaugucuuagucaggaggguuggauguaagaaacaagcccuuaacauucgcuucuuuguggacgagaugcaguagaaucauuuaguccuugcacucugagccucuccacagaauuugcuguuggaagucaucucaguaagaaauacacagagaaaucuggucuuuguuccuaugaugacaaagcaguuucauaaucugcccucuugcagcuugcucuguuuugggugcagauaaaacaagcaugguucucuaauaaccaccugcaccucugcugcaauguaaacagcagaugugggcgcagggugagaagggagaggaagcuacgugcaauggcagguuggggaauaaggaggcagaggggcuccuucaucuuuuacaggguaaaaugggaucaggacaguugcaggacagacuuguuucucaaccacgcuguuaagagaauuucauacugcaagucacaagggcccagggcuccacggccuuuagcccacccuggcuuucuaacaacccaaaguggguauggagaaauuguccuuuaaaaaccuaaaaacuauguuaauuuucauuuucaaaauaaagaauaaaucagcacuuuuggaaaggaggugggaagggaaucaaagugaacaaaugagcagaacaucacagcuuuaaaaaaauuuguguguguauguguguguauauacauacauacauauauauaauaccauauauauguauauaaaaaauagcuuauauauaagcuauuuagccugaacaaccagagaggaaaggaaguaauauuaucauuuacuugugauacagugauuaauuugaacuuucaguucuuugguuaagcuguccuggacuuguaguuccucuuaaacauguccuucuacaaacccauuuccugaauauggccaguauaguccuugcauguagagaucaugauuuggcuuuguagacuuacucuacguuucuaaaguaguggaaacuuacuugauaguauauuguuaacacugagacaguauuuauugugugucuacugugugcagggcugugacucagugcuauggggaaauauuuagauuaauuccucuucucaaggaauuuuagaauuugucuuuuuuuuuguugugaagauuuugcuuuuaaaagucauauuuugaaagaaaaauuugcucuuagucuuuuuuuuuuuuuuuuauugagacagagucuugcucugucacccaggcuggagugcaguggcgcgaucucggcucacugcaagcuccgccuccuggguucacaccauucuccugccucggucucccaaguagcugggacuacaggcgcccaccaccacgcccagcuaauuuuuuauauuuuuaguagagaggggguuucacuguguuagccaggauggucucgaucuccugaccucgugauccacccgccucagccucccaaagugcugggauuacaggcaugagccaccaggccuggcugcucuuagucuuuaagaugaaauauuauugacuuaaaauuagacauauuauuaaaauaaaauggggcuuuuauauacggagugauauuuguccaauaaaaugggauggaaaacuuagaucagaaaucuucucuggaagagaagucagggaugguacaacugcuuuucuuuccuacagguaaagauuagacgcuuacagauaaaagguugauggaaaccucuuauuuauagcuuugguuuugaaaugacuuuugucuaaaaauugugaaguggucuagcucagggccuuuuuaaucccuauucaccuuuuuaagugaacauaaucuuuuucuaggcugggcgugguggcucacgccuguaaucccagcacuuugggaagccgaggugggugaaucaccuguggucaggaguuugagaccagccucaacauggagaaaccccgucucuacuaaaaauacaaaaguagccgggcgugguggugcaugccuguaaucccagcuagucgggaggcugaggcaggagaauugcuugaaccugggaggcggagguugcagugagccgagaucacaccagugcacuccagccugggccacaagagcgaaacuccgucucagaaaaaaaaaaaaaaaaucuuucuagcaguuuaguuuggucguuucccauaaaguugaguguaaaagguuagaaucacucuggaaaugauagcccugcuuaccauaggcaucaucguugucuucaugccccacguaaagaccuuaacuggggacugaauaauuaaucguacugaucugucaaccugucacccccauugcauuggaccccucaucccuggcauuccagauuguuuuagguuguugcugguuuucagcuuuucuucuaccauaccacauuuuagaaagaaguuaaagaagauaacuucaaguuuuuagggcuuuaaguggaaaugaguaugaucaguugcagguacacuuuccugucaaggcuuggggagcugcccucucccuucacugcccaugaaacucauucugccagaguguguucaggauguacaggaguggcaggaugucaucuuugauggucauaaagaugagauuauuguaaauuguaagaauaauuacaggaaauaagcagucacugaggugaccuauaaacaaagauccuaauuccauauaaacaauucucauuuacaguuuucuucuucagacuaucacacagcuuuuuccaaagaguauacuuuucugcuuuccauaaagucucaggucacagcguaaauauuuguaucauuaaucauugacagguggaugcuguaaaauuggcuggucauauauuuauguaucuuuuucuuuuuuuuucuccgacauagguaauuaauaaaauuuccaggccgggugcgguggcucaugccuguaaucccagcacuuugggaggccgaggcggguggaucaccugagguugggaguucgagaccagccuggccaacauggagaaaccccgucucuacuaaaaauacaaaauuagccgggcaugguggcgggugccuguaaucccagcuacucgggaggcugaggcaggagaaucgcuugaaccugggaggcagagguugcggugagccaagaucaugccauugcacucuagccugggcaacaagagcgaaacucuaucucaaaaaaaaaaaaaaaauuuuuuucccagugguugguaguaguguuuauuaacauaacuuucuuagcaaaauauuaaaaauuaagggccuagguacuaaaaaauauucauuaaagucucucuaauaaauacuuuaaagcacuuuaaaauuaaauucugucaugaaaaauguaaagaacagucuuaguaguaauuccagaucaagggucuccuguugaaaagacaguccuuucccuauugaaugguguuggcacccuugucaaaaaccaugugaccauauaggugaagguuuauuucuaagcucucaauuuuauuccacuggucuauauguuugucuuuaugccaguacuauacacuguuuugauuacuacagcuuuguguuaaguuuugaaaucagaagugugagugguggugcugggaaaacuggauaucuacauacaaaagaaugaaguuggaccuuuaccuaacacaguguauaaaaauuaacucagagugguuccaugaccuacaacuauaaaacucuuugaagaaaacauggggcaaaacuucaugacauuggauuugccaguaauuucuuggauauggcaaaggaaaaauagacaaauuggacuuuacgaaaauucuuaaaaugugugcaucaaaagacuaucaguagaggaaaaaggcaagccacagaaugggagaaaauauuugcaaauuguaucugauaagggauugauauccagaauauauagggaaugucuaaaacucaacaacaacaaaaacucuauucaaaaaugggcaaaggucuugaauagacauuucuccaaauuucuccagagaagauaugcagauggccaauaagcacaggaaaagaugugcagcaucacuaauccaaacuacaaugagauaucaccucacacccauuaagauggccacaauccaaaaaacagaaaauaacaaguguuggugaggauguggagaaauuggaacccuugugcacuguuggugggaauguaaaaugacauagccacuguggaaaacaauaugauaauucaucaaaaaguuaaaaaugggacuaccguauguugcagcaaauccacuucuggguacauaucccaaagaauugaaagcaggaucucagagaaauauuuguaugcccauguucacagcagcauuauucacaauagcuaaaacaugggagcaaccaagugaucaucgacagaugaauggauacacaauggaauauuauucggccuuuaaaaggaaggaaauucugacaaaugcuacgauguggaugaaucuugagcacauucugccaagugaaauaagccagacacaaaaggacaaauacugugugguuguauuuaugugagauagaguagucaaaaucacagagacaaaaaauaacucaaaauggaucuaagaccuaaaacuaucaaacucuuagaagaaaacaugggggcaaaauguaaugacauuggauuugccugugauuucuuagauaugacaacaaaggcacacacaccuauaguuccagcuauuugcgucaggaggcuaaagcaggauugcuugagcccgggaauucaagaccagccugggcagcauagcaagaucccaucucuaaaaaaauaaaaacaaaaaugaaaaaaucaucgaggcagaaaguagaauggugguugccaggggcuagggagaugguagaauaggaaguuuaaugguccaguuuaaaguuccaguuuuacaagaugaagagaguuguggagaugaaugauggugauggcugcacagcauucugaguguauuuaacucccugaacugcacacuuaaguguuaagaauguaaauuuuaugugcauuuuaccacaacaaaauaauuuuucaaacuguacaguacaauccuaauuauuaucuuuuuuuuuuuuuugagacaguuucacucuuauugcccaggcuggagugcaauggcaugauaucggcccacugcaaucuccaccucccggguucaagcaauucuccugccucagccuccugaguagcugggauuacaggcaugcaccaccacaccuggcuaauuuuguauuuuuaguaaagacgggguuucuccauguuggucaggcuggucucgaacucccgaccucaggugauccgcccgccuuggccucccaaagagcuaggauuacaggcgugagccaccaugccuggccuuaucuuaucuuuuugaaguuguauuuaagauuagaaggaaauaauuaugauauuuaaaauuuucuuuuauacuuaauagaguuugcucaaacuuucuauaaaagcaaguauacugcuuuuauuaucagaaaaagauaacuguuuaaaacacaggcauaaaaauuaaaaagcaagacaaauuaguaagaagaggaaauucuucuauuuaaugacacuuuucuguccauucgguuucuuuuccugcuuccuaaaauccuuacagugaccaagaagucuuuugcaggggaauuacuauaucuguuguuuuacuugugugcugacugucuuagguaaaggagacuguauugaguuugguacauguugcuuugcccacaguccuaacauguuuacuccaauuagucccuguccccuuacccaccuccacuuacggcuugugcuuacaagaccacugccauguuacagcaaauccugcagcuucagagcaaagcugacucgacuggcuuauuuguccacuucugcuaaacuaaauggcaccaccaucucuauucugugccuacuggaauucgauagucccucaguaauugcaaauugacaccugauacuuuaccagaagggauaaugaaauugccuguuuuuucacauuuuuacaucucugaaauuuggauggcaaauuauaaucuuacaauugucaggaauuuuucuuccuuacuggcccaugaaauaauaguaugucuuacaguuuguagcaucauagaaucaagaaaaauggguauuuaugcacauaguaaaagcauauagcaaggaaaagaaagaaaaaugggacacacugcuaaaauaguacuugcuauaaacaaaugguuaaugucuuccuauucuacagagcauuugugcuauguagggagguuuauuauuuuguuguaauuauagaggcaaacuguauuuauacaguuuggacuugcagugauaauuuuaaacuuuaagucuuuguuuuagcccugccuggauauacagugagucaaagggaagagcuggacuuuucaggauauuaaucagccauuacucuguauuugaaaagcauaacuauaaaucaaauuaauauuuaguguuaauugaagagugaguccagguugcugcugacuccucauauuaucauucauccuuggcuauaaaaggacagucucagauggucugccuuauguuacugugaggagaaaagagaaaaggaaaaccuugugauugacaaccaaaauggcuuuugcauugugaauauggaucagagcuuucacuauggcuugcaagcacucagcugauauugauaaggaagaaacugauaaugagugccuucuguccucaaacacucaauuaccgagguucugagaaacucucaccauuagcuuuauagcuauguaagacuugagauuucucuagccauuaauauuauuucaaaauuacucuuggcuuuaucuauuagcacuguuaucacauauuugcugguaggaucacaaccauggagucaguagaaagacccaaggaaggcauugaaaggaugguuugucuuggcugcagugcuguuccucuauucaucauccucucuccuguuccugugcccgcagcgaagcugccgcccaugcugucgccacccuggcugaggccaccuuacaaggugggggacagaucgucuugucuggggaaaccgcagcagccgucggagcacuuacuggaguccaagaugcuaaugguaagagagcauaaauauuuuauuaaauuucuucccuguuuccacuuaaaccuuccugacaugacuggcaacaaagccuucagaaagaguuugagcuucgauuuuuuuuucuucauugguagacauuucaugccuaggaauauucugggagccugugauuccuuucacuaguaggaaacauggggguuccugaaggaaaauacugugauaauggcuaccuaauugaauuguuacuuaaaaagugauuaucgucuugugacaagacuugcugagaagcaccuuaaaauucacugugagccacauuuugucuuuuacugucucaucggauaggguagaucaauguccuuuacuguagcagagacucucucaugggcaggaccaucauggaaaguucugacuacaucaagaaaggcgccaaugucucaccugugcuuggggucaggcagcaggcugugaugccggugccucucugguugguacugugguucugcuuccuguuauauguagccucacgaaggaccuuuggauuuagccaauuacaugccccuacccugagcuucuuccccagcucuuugacuuccuggacauuggugaauauccugaauaagcaaaagggauaaaauucauagaaauaugguggcaaaaauauacaacuucagcccaguucuuuggguccauguugguaaggagucaguuggcaagacaagcugcccaaggaagugccucagaagucugggucaaagaggagggccagaucuguucugugagacccuaugugauuguuauauuuuuaaauaauauauaauuaagcaggacaaauuaaauacuccauggcuuuggggaaauuguugcuuuaaaguccuggaauggggcugggcacgguggcucaugccuauuaaucccagcacuuugggaagccaaaguggguggaucaccugaggucaggaguucaagaccagccuggccaacauggcaaaacccuguccaugguggugugcgaggcugaggcaagaaaaucgcuugaacccgagaggcagagguugcagugaccugagauugcgccacugcacuccaaccugggugacagaaugagacuccgucucaaaaaaaaaaaaaaaaaaaaaaaaaaccaauccuggaaugaggauagauaaauaacauacuuucaucauguaggcagaagguuccuuaauggcauuaguggcagaaagaaaaguaccuggcacuuuguuuaugguaggugccuaagaaccgaaugcucuguuaguuggaaaagucuuugaagaaagacauagugcuguguccuccuuuggaauaggaggaaacaaaguaccucugucccgccagagaagaauaacauaggaaaugcaaagagccaucguggcuucugagaaucauuuuccaaagaugccaaacaaauucaauucuaaaacuauagccuacuuuuucuguagggaaagaggcuuuugugcuuaucuaaaucuagacagaguugaucucaaccagaaugcuguaggacaaaggacaucuuauagccacacauguucaggaugaaauggaccaugguuggaauuaaggagaaccucucucucuagcuagacuccuacuucuauuuuuuuaccuuuuucuauuccucaucagaguccuaaggcacccugagcaaaggguaggauaucuggcuuauguggcauucaugugaagugugauugcucuuauucacuauggaacugcuaaaaauaacuucccauguggguucaguaggaaacuuuauuauccauucuaaucgacuugaccugucugggagagaacagacugcuuuauaauucuggcuccuccccagcaucaccuuuucagauggaugaauuuauaauaaguccaaggacccucuggcucucggccaaguagaaccguucagccauacaauaaaguugaaccacacccgcuacuauugauuacuggaagcugccucuuuucaguagcauuggguugugugaaucauuuggugugauuucauguuguuggcuacauuugugaucugggaaaauucugguucgcauccuaaaagccaguauuucccccaaagcaggccauccucagucugugacugccaguacuugcugaacucaggccuugagaguuggaaguuaucucuuucugaaugcagcauuucuguaucaaaucagacccuugaguugugccguaucccagcaguuuuaggcaaaggccaaucauuucaucugcccuugggaauccaaagaaugaaucucauaugggauaugauccaaguaacuuugauaauccucuuaucuucuaacauuuuugcccacagugcuauaguauuuacuuugggauuggaaccagauuuuucccucuuaaucagcaauuuugauaucuggcuagacuuuuagagguucucuuuuucaucauucuuucggauucuguccuguugccagaguuuguugcuucuuuuuguuuuuguuuuuguuuuuugagacagagucuugcucugucacccaggcuggagugcaguggcacaaucucaacucauugcaacuucugcuuccuggaaguuccaaugauucucgugccucagccucccgaguagcugggauuauagacgugccacaccacgcccagauaauuuuuguguuuuuaauggagaugggccaugacuggucuugaacucuggccucaggugauccacccaccucagccucccaaaguacugggaauacaggcguaagccacugugccgggccuauguuugucacuucugggcagacaagcuuaugguaucugccaguaggucacauuuuuuuuuaaucuuuuuucuuuuuuuaauagaaaugaggccucuccauauugcucuggcuggucucaaacucucgggcucgagcgauccucccacuuuugccucccaaagugcugggauuauaggcaugagccaccacacccuguccaggccaaguuuuuuuaaucagaaagaguuuauuaucaggaagaaccagaugauagcagaacaaggugcuguuuguugacauagaacuaacuuggaaacagauacuacuuaggggaaaacauguaucccauauuucagaguaugguuuaaaucaaaauuggaauagcagaugacucuucugagagcaauuuggauaucauucaguucugaaguagaaagaguuugugggauggaacuagcagggauagaggaccacugcauguggagccugaugaaguccauaaccauugggaaguggcgcgggcgggugagguuaugaagcaguauccuaggggaugguguuuuucaaguuagagauaaugacccauaggccaggcacaguagcucaugccuguaaucccagcacuuugggaggccgagguaggaggauugcuugaguccaggaguccaagaccaaccugaacaacauaguaagaccccaucucuacaaaaauuuuaaaaaauuagccaggagugguggugcacaccuguagucccagcuacuugggggucugaggugagaggacugcuagagcccaggaagucaaagcugcagugagccaugaucacaccacugcacuccagucugggugagagaucaagacccugucucaaaaaaaaaaaaaagccaggcucaguggcucacaccuguaaucccacuacuuugggaggccaagguggguggaugaccugaggucaggaguuugagaccagccugaccaacauggugaaacccuguuucuacuaaaauacaaaaaauuagacaggcaugguggcaacaccuguaaucccagcgaaucgggaguuccaggcacgagaaucgcuugaacccaggagauggagauugcaaugagcugagaucaugccacugcacuccggccugggcgacagagcaagacuccgucuugaaaaaaaaaaaaaaaaagguaaugacccaugcaagccagaaguuuaaauuuuggaucaccaaagcagaccugaugaagacauugcaccuagcaccugcgcacccugaagacuucuuucuggacauguaccccacacuaccccgacacuaaaggaacuacccaagcacucacauuacuuuauuucuauguucucugucuuuuucaauagagucuuuggucucuuaggauggaguuucaugguucgguucaauauaaagauuuucacagaugccuuuucauuuagauguagguagaauugccuaaggcuggugaaggcuaccagauuaauuccuuccuuuacuuguuuguuuguuuguuuguuuguuuguuuguuuugagacagggucucacucugucaccuagacugguucacugcagccuugaccucaggcuaaagcuauccucccaccucagccuacugagacgcugggaccacaggugcgcacugccacaccgcgcuaauuuuuuaaauuauauuuuuuguagagaugggaucucccuuuguugcccaggcuggucucaaacuccugggcucaaaaugauccucccgccuuagucucccaaaguguuaggauuauaggcaugagccacuacacccggcccuuuacuucauuuuuugaacauaguuaucucaauacucuuuucaucuuauacaccuuaauguaagaagucauacaguucagcccauuuguuuuucuucacucugccuuccucucugcugguccccagaacccccuguguuccaggacuccugaccuccaggacugacagauacaggcauucacucagacuugaggagcucuuugcugagugccucucaccucucacccagaccuuaacacccauuguuggcaagccucagaaaaccaggccuauagaccuuucucuuccuuccuauugcagcaaacguaaugaaagagaaggauuauauugggacuuggccaccucagaaacacucuucugucugagaucuuauugcagauuuauacagcuaucuuucauuccugaaaaguagaugggggaaaacaaaauagauuaacaaguucguaaguauugguuggugcaaaaguaauuguggguuuuuuugccauuagaaggaauggcauauuugaaguuggugcaauuacuuucacaccaaccuaauaagccucuuagcagagcugcuaagaaagcaucagcauuuuuuaauauagcugacacuuuuccuaaugaugcuacaagaaaaaagagaggauguagcauuugcugguuuggagugggguuuuuuuggguuuuguccuuugggguuuuuguuuguuuguuuguuuuugagacggaguuucacucuuguuguccaggcuggagugcaguggcucaaucucagcucaccgcaaccucugccuccuagguucaagugauucucuugccucagccucccgaguagcugggauuacaggcauguaccaccacacccagcuauuuuuguauuuucaguagagacaggguuucuccauguuggucaggcuggucucgaacucccgaccucaggugaucugcccgccucagccucccaaaguuccagaccagccugggcaacauggucaaaccccaucucuacuaaaaauacaaaaauuagccgggcaugguggugggcaccuauaaucccagcuacucaggaggcugaggcaggagaauugcuugaacccaggaggcagagguugcagugagcugagauugcaccauugcacuccagccugggcaacaaagcgagacugucucaaacaaacaaaagguucaucuuuuaaauuugaaaaaacuuuuauucaaaauuccaaagaguguuuugggaauaugaacuuuauacugauuuuaaaguucauuugaaagaauaaaaccugccgugugcgguggcucacgccuguaaucccagcacuuugggaggccgaggcggguggaucaugaggucaggagauugagaccauccuggcuaacacagugaaaccccgucucuacuaaaaacaccaaaaauuagccaggcgcgguggcgggugccuguagucccagcuacucgggaggcugaggcaggagaacggcgugaaccugggagguggaguuugcagugauccgagauugcgccacugcacuccagccuggguauagagcgagacuccgucucaaaaaaaaaaaagaaaaggaaagaaaacccuaucuuagccauuuuuuaugcuaacaagccuuuaaacagaaccacuaauaaacuguaaaauugacucaaguuuucuccucugcuucuaccccagcuuuccccagguucaggguuauagggaguuuucaucacagagauggaccaggugagggaagcaaguguucuugcacuuugaaauuucacuuucuccuuuauauucuuuugauuuuuuucaauuucauuuuuuguaauaaagauguuaguggaggcccgacaaaguaguucaugccuauaauccuaacgcuuugaaagguugaggcagguggauugcuugagcucaggaguucaagaccagccugggcaacauggugaaacccuguuucuacaaaaaauauaaaaauuagcccagcacugggcucaugccuauagucacagcuacucaggaggcuaaggugagaggauuccuugagcccaggaggucgaggcugcagugagccaagaucaugccgcugcacuccagccaggaugacagagugagacuccauuucaaaaaagaaaaaaaaaagauguuagcaaggcauaccccacuuguggagcucucugaccuaggacaucaacauacuucucagcuguugaccuugcauucugucucucaauccuguuguaucauuauuuuauucauuuaacaaaauuuacauaaucuuacuauguauaagcauucuaaguguuuuacaugcauuauauuuaaaacgcaugauaacuuuaugaguaaacacuguuaaacugauuuaacacauagggaagcugagacacagaaaguuucaguaacuuaaccaaguucacauagagaguggcagacaauucaggcaauuuguuuccaaaccacuguacuacacugucucccuuugaugugagcucuggguuccugccuagacuccacaaauacagggugauaaccauuguugaacaaauaaauuuggaaaugucaaaccuuuccccaccccugccagaggcugcuugccuuagucuaguuuagccacagcacccaucugcccagcuguuccgagggcuguagggguacccuggagguucaugcugcugagugccccgggcucagcagcccucccucugcacacacacaggcuugccuuugcuggccagaggagccgacaggucuguaugcuucuccgguugcagaacucaucauuggcuggcugucagccuuaaacauuuucagugagcagaguacuuugcaauuagugaaugugucuucuugacuggaguuggguggugggcuacgggugcuauuuagagccagggaaacuaaggggaaguagaugauauucagaaggaaggaaccccagcagacgaguuguuucaucagcuccuagaagccucugcucaagccuuccugcugcccuucaguuuaggccaggacucuuucagccuucccaccugucucuaacaaaguugagaccaaggugguagggcuguggauccuggggaaagggucaggggcguguucauuuuugccuggagcgaguuuauuggcuuauuuguuuccccagcuccucaccgggucuuccacuuggcucugccuacagcccuugcuuggggucccccagagauuuugaagagcacaucugucuccgcuggucagcacugaagacucagaaaccaccuaugcugcccugguuaagacuagggucucaacccucccuccucauguucugaaugaagagaaauggacuggagggcuguuuaaaaauuaaagcugcugggugcgguggcucacgccuguaaucccagcacuuugggaugccgacgcgggcggaucacaaggucaggaguucgagaccagccuggccaauauggugaaacccugucuauacuaaaaauauaaaauuuagccgggcgugguggcacacgccuguagucccagcuacuugggaggcugaggcaggagaaucgcuugaacccgggaggcagagguugcggugagccaagauugugccacugcacuccagccaggcugacagagugagacuuccuaguaaauaaaaaauaaaaauaaaauagaauaaaaauuaaagcugaugacaaggcauugucauuacacuuagagaaggaacagcccuucgcaaguauccucaggguagcgugucccacguucugggcugguccuggcaacagucuugcugcugagguuccaccuuaagacuucaacgucauauuuucugaaacuauaagaccaccgggcgcgguggcugacgccuguaaucccagcacuuugggaggccgaggcagauggaucacgaggucaggagaucgagaccauccugacuaacacggugaaaccccgucucuacuaaaaaauacaaauauuagccaugcgugguggcaggcaccuguagucccagcuacuugggaggcugaggcaggagaauggcgugaaccugggagguggagcuugcaguaagccuagaccacugcaguccagccugggugacagagcgagacuccgucucaaaaaaauaaauaaauaaaauacaaaauaaaaaaauaaaauuauaagaccccacccugccuuacugugcuguaaaacaaacguacauuuuacuaugcauuccaacugccaaauuaaauuaauauagacauuucuuuagggaaaaacauucuaucuuuuuacacuagacaaucuucaccuuuucacaucccuguuuucuuugaccuuauuaaaaacuuuuuaaaauauguauguuuucucagcagaauuuaaucucagcaaugcucaauagaauuuuuuuuuuuuuuuuuuuuuuugaggcagagucuuacucugucuugcccaggcuggagugcaguggcacaaucuuagcucacugcaaccuccaccuccuggguucaagcgauucuccugccucagccuccugagagagcccagcuaauuuuuuaaauuuuuaguagagaugggguuucaccauguuggccaggcuggucucgaacuccugaccucaaaugauccggccucccaaagugcugggauuucaggcaugagccaucacgcccagcccaauaggauauucuuaaccuggggucuauggacccugagaaauucuauacaaagguauuuguauuuuuuuuugguaucuauagcuuuuuuuuuuuucuuugccuccgcuagcagcagggaggguauuagcuuugauugaauguguaacuagaccagaggcauucccacccccacccccaccccuguucaucuccagcccacaaaaaaagguuaagaaccucugcuacagaaggugguggugaggaucauuuaacuuuguagauaccugguauagcacugagaguaaaaggaggagcaauggagaggggaggucccgcagagcuggagacccuaaaagcugaaccucuaacaagcucuguaaucuuaggcaagcaaauuaaccucucuaagccuuaacuguaaaaauuaggauaaugauaguucuguacucagaaggaaguugugagcauuaaacaagaugauuccugucaaguucuuagcauagugccuggcacagggaugcaucauaaauauaaaauucuuuagcugucagcaucaauuucuucuccaucauuccucacauauguuggagugcacaguacuauguagacgcugcuuuccugucuuuaagacggauccgaaugcuugccuuucgcagaugaagauguauguugcagagguggaugcuguaaaaaugggacuagauuagaagcccuuucuguaaccuugacugaagaaaauacaaggugacauuguuuaaaggcucuaucacuugccuuugucuagggcugcuguucucuucugcacauaguuugcggucaugaguguggccuuuuuacuccuaaaauggcacaaugugucuucaaaucucaacagaugcauuguauuucaacucuaucaugaaagguagcuuuugccauuuuuuccuuuuugucaccaccaucauccauuuuuacuuacugcaugucccacuguuccaacucuuuaaaaaugagagggaugaugccaauccuccacauguuagacuguaaaacacaucuccuuccaccuuuuucuguguuccuuguucccuggacacaucaguauaugggcuuguucucacaagaguccacugagauguaaauguuaauuuaggaacuguauuauuguuucuccccaaaaagguugcugaugugcuauuccaguguguacuaaaucacuuuuugccucauuauuuuaaaguuuaaauaaaugaauguauuaaauagucuuaguguaagagugcguuuucagucaccauaagcauaauagccuuaaaagugcuguuguguucuaugacacugugauacuauuuguagcuuuuauccaaagaugguaagcucagugccucaggacuugaagcaggcagccccuaagcaacuguuuuuugugugagcugugagucccaggauacaagccucucaucuucaagguccccaaagagcagcacagcugguagcuguggauuuuuaggcugcccuccuguaagguaaauggucuuuuccacccacucccuuguugauagagugccuugagagaaaaugaagacacuagagugcuggucucagacugcgcugaggcaucgccuguucuguaagaaaaagcaaaugaagauucauguguauuacaacuguuucuccuuuggaaucacaggccuuuuuuaaauagagggggaggaggggauaguccuagaccugaaaagauuccuucuuguaauauaaggagagcugugagcuguggaucaaaaugaagaggagugaggggaguaugcagcguugccuguggcuccagcugagcugggagccggcggcuuuuccugggaacuguauguggugcagcaccuugggacagcagugucucuuagugucuuccacacgccccccugggaaauaggcuuucuuugcagacagggacuuucccauuuaagucagcuaacuuuucucuaagaugaaucguuuucauucugggaagcauguugguagaugucauaccaggaaaauaaccauuucagucggcuguaauuuugccuuuuggcuauacacauugagcauaauuauuuagggucuucaucuuuuuccuuucauuguccauucuuucauuuuguuuuuuuacuacugcuacaaccaccaccacugccaccaucaucuucuugcaaauggcuaagcagugucugcauuauucuaccuucacccaguaaacugaguagaauagaucuucugagcccuguucagaagcagcuaaaaccgggacuugcccaggaucugucagcucuuaaauaguaagacuggaaaucauaccagaucuccaguacucuuucuacugcccaaugaaacucccuucuuccccuucacucccucuugccagcuuagccuaccuaggaaguaaagaaggcauaauacaaaugaaaaucauggccuuuauuauucaucugguuaugcuaguacuugguguggugacuccuuugcaggauuauuuuaaagaaugguggcagcuauguuuuacucacuuuagaagucaaagacucacgguaaaucuuagcagaggcaaauaaaaacaugauaccaaaaccuaacaucuaaaucuguacuguccaguaugauagcuguuagcuacauguggcuauuugaauuuaaaugcaaguugauuaaaaugaaauaaaauguaaaagguaguuauuagucacaaucauauuucaagugcugaauagccacauacgcccugagauacugaauuuuuaauuuaauuauaauuuauucacauuuaaauguaaacaggcacauguaccuaguagccacuuuaauggacuguguagauacagaacaugucuaucacugaagacaguucuauuggguggugcugaucuaagggcuauaucaauaacacuguggucuccuggcaaguuguacccucucuguacaggggaggacaacacaaauacuucaugagcuuugucuuccagugaccuucucagcucauaaacagcauggcuuugcuuuuaaaaaaaaaaaaaaaaucuacccaugugacugcaguaauccgcagccaguaaacagcagggugggaggguugcgaggagaacugaucuauuuuuaugcacugcagaguccaagcaggaaaaccugagaccggagacaguggugacaucaagacucacuuccuagugaguuuauucaugacucaggccaugugcauauuuccacuuggauuccucacaagugcaaguuucucuucuaggcuacagguaucugcagccaggugcuguaauggauuuauaguagcccgccaaaagaucaaauaucugaagccugacgggucacaaagcugacaggagccaugacuauugcaugaauuccagauuucacagugaaacagagcugcugcugaaaaaugggagcacagagcuguucacuggggcucuugauucuagacacucaaagagggguacaguucucugccccauguguguuucucacccaaccuuuucaugguguugaggaggggaagggacagcucaguggugauucuucacuucucaaacguguccuccuccucugucuucauaaugaccuccugaaguccaaagugccuuccaaaauagcucuuggaaagagguggcaguuuccugacuccccaaucucccccauccugggagauguguugauggcacuaauuugcgggguagcagagacuauaguccuacucucuuuacuggcuggggcauuggaggcaugcaguaacuguugacuaccacugcuacaacugcuguuaugauuauuaccauuauaaugauuaaucacucacaccgaaugggaagggaaguaaccuucagagguucacucuuaguacuucuggcacauaugcuuagggccagggccagugagucuucauucgcagagaggugguagugaaucucccacaaggaucccuacuucgggaagccuguguuccugguggaagucccaucauaucccucaggcauacugagauucucuucucuagaauuaccaggccuuuucugucacuccucaggcauaccccccguagcuggagggauuuccaguugccaggguucuuuggugcuuuucuuugccuccugcagagaugcugagcuguggacaccuucagaaagaccagcacugccucaugagaguaucuccugucccucuuugcggguuuagguuccuuguguagucugcacauccagaggggaugugucauucucucucuaccauuauaaccugggguggccucgggcauucaucguuuauaugccaggaauugcuaaccuaagcucugcuauuugaaggcuuaaagacugcagaucaaaaguagacacagagggccuuuacaaugagaugauaggccaguagcugucauucuuuauucuuagugcucaucuaagccaugaccauguccuucagauguagcuuuuagauacuuuucaugugaaagacuggauaccucuagucgacaugucagggccccaaaggaaucaagucccuuuggcauaccuucauguccucuuuuuuuuguuuuucuguacuucaauagaugcaaauucauuuacucuuuggucugccuguguuggguauucucagcuuggggaaacucaaugagccagcacaccauccuaugaacagaacaccaaucugagccagggacauuccgagcagacaacucaggucagggcuuccggacagauucccaaggucccugccaucuggcagauggacaccacugacuguggucuccucuccauccacgguguccucaaggccaaguuacaugcuucuuugucucauucuccuucccuuuagguccgcagaucuuucggagucuuuguauguaaaggcagauuuuggucuuagauuauuccagcuccuuauaaaccaagacugaaucuugugccugucauugugagcgcuauucuguaaagggauuuuuuuuucuggcauaccaaauccagagccauaauuggacaaguuuaauuggagucauuucuauucaauacauggauggcaaaguggguuuuaauugagcauguaaaaagggcauuaaucacuguucacacaggaaucacaauauuagaacaggaaaaauucuuauaaaguuuuucagguucuuggguaaaggggacuuuccucuuuuuauuuaugcuuccauuaggauuuugaaggaaugccagugcacuguuauuaacucuaauagcuugucccucgcagccaggaugguuuggggcccucuggcucucagguuaccuguguaaauacagggauucacuugccagcacccagcucugacauuugcuuaauaaagagcaaaugugcagaacccaacagcagcagcagccuggcagaagcaguaaucugaacaggauaaacaugcuuccucuuugugcgaugcucuuucuccauccuucugccaagagcaggauaucaaaugaaggggagguugugguuggagucagugaagugaaugucuaaguggcaccugcuucauucaacagaucugcuuuccuggggccucccagugcacaucugcuccugacaaagccucuuuucuccuccuauuggucagacugagagcaaaggccuggcaaggagacauacugguuuugcuuugucagcacaauugccugugacauuauaauuacaccaaaucuucauuauuagaaaggccccaauuuagagauuuucagagccuaaaugggauuuucuaagugaaauugauuaaaaaaaaaaaaaaaaacaaaaaacuuugccaucauaaagccuagcaauugcaucugagaaucauugaaggggucuaaauauggaaaccgagacacugcugugagugagacuacaaagaccaugcuaucagauuggcucgcuagagaggcguccagcagucuuccgacucugcccagcccauccucuccuuauucccguagcacuguaacaugcagauaccuacacugcauugcucucacaugcugauaguuucucaugcagaggccuggugggggaggggcuggaggguguuaaaauaaguugaugagguauggcaguaaaggaaagaaccugugacuuaaauaagggaaauaccagaaaucuauauuuuaggugaauacaaagcauccaauuuagauugaguuuccauuuaaacaaaggcaacucuuaagaguguugcacagugugaguguaugugucugucugucggaggcacguuuaugauauggaguuggcacacuggaagcucuggaaagguuuuagagcugugcucuggcuauuuaaacuuaauuaaaacagaauaaaauuuaaaaaucaguuccucagucacgcuggccacauuucaagcacucuguagccacugugucggacagcacucaaacagaacgugcccaucaucacaggaagcuccaguggaccacacuguuugagguuggucugaaccucuugaaaugccucggcugcuuaaggaagccugggaguuucuauugcaggcuuguuggaaggaaaaaaugaaauuugccucaauguuucuggaacaacuccuuccagccauguuaccuagacuguguucuuuuucaccuuuuuguauuuuuuucuccaaggauuucauguccuuugccuacuccuaccccuuguuuaaaaaaaaaaaaaaaccugaauuauaacaaugaaaaggaaauuuaauuuuaggaauguccacuuucagcugaccuucuccuuggccuucuccuaauuaaacuuucacagcccugcuguuggaccagacaguccuuuucucauuaaauggagcaccuuaguaaaacaagagggcaugugaacacucgggccaagaguguguaaacaaguugugcauuguguggacaaugcugcuggguguggaacgcugggcugccaacacuuuccauuuucagcaacucuugggaccaaggacagggccuuuaaucuugcuucuuccauuugucugugucuaguagcuacuacacaguugcuuugacuccuggagaaagcccacguaaaauaacaauacuacuucaaauuuagacagugucuuuuuuucucaagaacuuaaaucauguaagcaugauguuauuuauccucauagugguccuaagauacagaaguggccuguugguuuuacaaaugugaauauagucaacucuuacuuguuaccuacagauuaucugucacgcagauuacucgugacacauuuuaaauccuugggcaauuucucugagcgagccaguguaagccuggaccaucuccucugccccccgacccagcugcuggguacuuagggaauacaaauuaguuuucauauuagcuuaaagaagacauaauuaggaagguaagucugcuacaagaaaaucacaucacaaauuccaacggcgagggggaaauaugagggaaaugaccuccucucccuucaacugaacuaagaucugguggucuaagugcacauuagcacuuggugcuggcaugcuugccgaaggcuuuccucacggguggaaggagcgaggcugugcacccugcaccagaugugcaugggaggcugcaagcgccgcagcggggcugguggcccaucuugcccggugcuuuuuuuuuuuuuuuuuuuuaacaguucuguguuauugucaggccucuuuauggcagaucgugcaggucgcaaguggauccugacugacaaagccacagguggguucaucuuuggggaaagaaggaagcagcuggaggauagagucacugugaggcugucauuccaggcgcugcuuccugcuuggauggugggauuccucuacugugcagucccccucacucggucaccugauaguuuuaguaaccauugauuccauugauuaucugauuuuucuaguguuaaauguuuccuuuucauuuauuagcuggaauucuuuuuuaagagacagggucuuacuacauuacccaggcuggagugcaguggcuauucccagacuacagguucgaacugcuggccucaagugauccucccaccucuaguugggauucuuuuauaaagaacuuguccccauuaacaauuuggcuaugcuaaguacaguucagauaggaaaagcaggagaaaaacuugaugaagaugaacuuuauugggauagaguucuuuccaucuuacucuaaagccccauuacugucuauuuccacuuacugaucugcuuuuuucaggugucucacugccuagagcaaauuuaauucugcccuuuaugugcucuuaaaaaguuuuaguuuuuuugugguuuuuuuccuaaauggugcucuacagauuaugcugagugaggggaugaaaagucacgaguacaucuuuggaagcuuccuugccucagcguaucccugcucagauagaagaggcagggacuggaugacaggcacauggggguucauuguacuccucccucuccuggugccuauuugacauuuuccaucauaaaaaguuugaagaaaaaaaaaaguuugaaaguaauaauaacagaaaaauaaauaaaucucccuuccuaacucugaguaacuccugagugggccugcuguucauuucugcaccugacuguugcaggcuccuggugacuuucuucuucugagguuugucaucugggcuccacuuuccauuuuaaaauauuggugcacucugcauauugccaugaucuauccucugggacacagacuucaaccugaguguuguucccacccuucuuccuagugauuucuucugggaauuuacuggguaccccuugccuugcucuguacagucagaucagauguccuccagagcagggguccccagucccuggcacggcaggagguggguggcaggugagcaagcaucaccgcccgagcuccaccuacugucagaucaucagcggcaucagauucucauaggagcacgaaccuauugugaacugaugaucuaagguggaauaguuucauccccaaaccaucccccucaaccccccccccauccauggaaauacugucuuccaugaaacuagucccugcugccaaaaaugcucgggaccgcugcuccagagcacgugcauauuccacaagcuucagcagaacgcuuucucuccugccauuuucaguuuaaagccuucuuggcagggucaacaggccuugcaguuagcuuguucauccccacguugggagcucaauuuucaggauaauaaaccauggugguucugaauacugaaacacagagcguuucauaacgcuccugggcauugccaguaauuucaagaggaaaucaugacauuguaucuccaaaauaggucuugagauauauuuacuaauaaaguaaaaaugaauucaguuuuaauauuuggcuuaugggaugaggggcaugaaaagcuuccugguggucugcaaaagcaggcaaaagauagagugagccugucucaaccagagucacuccuuugaauguuauuccagaaagcaguuuuucuuagucuugagaugguccagcaagagagaagaaaacucuuugagugcugaaaagcacccugugcaccaaggcaccugugaggcugcucuuggcuucaugagaauauucaguacuugccagauguaagacauauuuuaauccauaaaucccccaaauguacccaaaagcuuggacuuaggaaacacggaaaagggagauuaaaugucccaaaagcagcuaauagaacagaaacagaaccacugggaaagaaaugcuuuuucucuuccccguuugcccuacuaucaugagguuacuuggaccuccuuuuuguuugauauugacauucucuucaugaccuuccucuucuugcccuacauauguccucuuuccaucuaguccuugguauucucagccugucuaacugcugucugccugcuagacuagcuucuuuacugauuuccuguuaucuucuuccacuucuauacuggcacauaccaugccuguuuuucuucauauaguggcuuuccuuagacgucagccacugauguaaauauuuuuccaggccuguaaauggaagauuuuuaaaggacuuccuuccugccugucaccccuagaaacaccuauagauaccguugcuggcuccuuaaaaacucaagcaauauaauccggaauuuaauuucuuacucacguauuccucuccuuucuaaucauggucccgguucccauuugggccaguauuucuuugauguacaugguuagcguucauguucauaaacuaaagaaggcauuacguaauguaaauuucccuuuggguuuuaagaauuauuucuuuuccaccuacugucauguuuauuauuuguuuagcucucucuuuuucucucaacagccaucaauauuuuucucccaacuaaagauauuuccaugaccaccuuggaaggccuucaggcugaaagauucaguuacagcaaacaacaauucccaaagguuucccagacugugagggcaaaugaaaggcccauucuuccucagguugucuguccugcucuaucuugucguggggugaggggaggagggccagcuauggugcuggauaacuucaacagcccugcagcccugugcucugccuggcucaagucuguuaguuucuggaggacuucagaaauguaucagggugaugacaucacaucauacugcccugauuguauuuuucacauucuuaauauugaggagugguucugccugguugcuuauugaccagugcacucgauuagcaaccacuucaucuacgucaugugcagugccaguucugaccaucacuguguuucagaagggaagcugccugccaguccaucugcccugauuucauggcuguuaucuuuaaucuuuacaucuuugaaggccuuuggugaaugaugugcuuccuggcaggagaaaaucacugcugaaaggagaucuguguugucucugcuuuucuuucuguuucccgagagcuuuagucuaacaucugugaccccagccagacuccaucaaacuucauacucaaagucaucuuugaaaagcaguggcauuuauuauauaccuacuaugugccaagcacuguaauagauuuuaaugugucaucccaucuaucuaguuuagcagcccugugagaugagugaucaccauuuuacauaugaggaaacaggcucacaagccauuaaacagcagaaccaagauucacauguaggucuuucugacugggaagccuuuaauggaaauaaacagccuacuuuuucucacauaaaaugcaccugaucugcagcaccaugagaaugguuguggagaaaauucgacuucauucugaaucagaguaaaagguguuaaggcuguuuggucuguggagggcaagacuaaagggacuaccaucaaguuucugaaauucaugaagaguaugaucaaugauacauuuucauaucauauucaauuauugagcaccuacuguguucaaguugcucaacauuaaaagacaguccucggccgggcgcgguggcucaugccuauaaucccagcacuuugggaggccgaggcaggugaaucacgaggucaggaguucaagaccagccugacuaacauggugaaacccccaccucuacuaaaaauacaaaaauuagccgggcgugguggugcgcgccuguaaucccagcuacucaggaggcugaggcaggagaaucacuugaaccugggaggcagaggcugcagugagccgagaucaggccacugcacuccagccugagcaacaaagcaagacuccgucucaaaaaaaaaaaaaaaaaaaaaagacagucuugccaacaaugcaagcaugcagauuuauagacagaaaagcagcaacuccuugggaacaggucagcacauaccuggggccaaaugaaugguggcggcaauaaagucacaggagggagaaaccaggugggcuguccccucagaggcaaccccaugaaccauguggaaacugcuagaagaacuggccugagacuggcagggccuaauuccagacagagagaccugccugaggaaguucacauggcauccaagggacacaugugauuguaaugaggggauaguguaggguguuagcaggaaaggcuacauaaacuccuucaacuauuagcuauuuagacuuuauuuuccugauaggagaaagcaaaguaauguuuuugaugggaugggauggcuuuugccaaacaauauuuuaagauguuaaccaugauaaacauacuuauucauccaauaauacugaauacugaaagaaguuagccuugggaaaaauaaagucccucaaaauaacuaaauaaauuccauuuccacggauacaugcacauauguuuauguguguaaauuucauuacacaauaggcaagugaugaaacucauugccccaggagagaucuggaauagaguagauuggcucaugaaugauaaauccagagugugcaagacugugacccuaaccuuuaaagcaaaucucacuggugcccguggucuaccacagugcuccccuggugccaccaucagagacagaccacuguaaaaccucauggccccuuguuuugcagcgugcaaggccaggcuuaugaauagauaucaucaucugccacccauguaaugugaucugagaggcaucacuuuguacggaaguuuuaaaagaucccucuggcaggcgcuaaaguaggguuauuacaaaggaaggcaagagaugguagugucuguccagggaggcagggggaaaaguguugaauuuggguucuguauuugaagggagagaaucagcuggugcauuggaugugugaaguaaaggaugacuucagagcuuuuggccugagcaacuagaagaauguuauugccauuuauuugggaagagaggagacuugggaaaagcauguuucaccauuuuggcucaagaaugauacacauuaaaaaaaaaaaaaaauagagccaugucaggccucauuguccuugacagggaaacaugguccugcagccaguucuuccagagauuuggguccaacugcugcuugacgaggaaaucuuuauguuggcaccugaaguuucugagucaccuuugacuuuuuuuccauuuugaccaauucuauaaaccuuaccaugaagcuugagaagaaaagcagcagggggcccaaagaggacaguccucucccuucuggauccuuccuggcccugguguuaaguguuuaaggacauucuaauauauggaaaaagacucccaaaucaaaggccugggucccugacuuuaccaucaacucagucauuuggggaacaaaaucaguccuccuuugaucuguguugagguuuuuuuuuuuaauaaaauuuuuauguuuacuuuugaguucaaauaaaaagacggguuguauuuacuaaacugaguuaacuccaagguuguguguagcucugaaauacuaaagucuucaggacauuagaaguaugugccuuuaugaugagcccgugguucuggcucugacucgugaaagggaaggagcccugcccuguggacuucucuagggucucagcagaagucaagugacaugcagcgggggugagagggcucagaaaggggcuguacugaggccaagggucucauuaccaggacucuacaagggcccuguaagaaaaaggagcacuuccaccccuuaaaguagaacacgaagggcuuccuguugcuuaaucaaucgaaaugacccagaauacaagcuuggauuaacaugcgccucuagauuagggcuaaucaggggcaggcugagcagaugcagggacagucccagccugauuacuguaccucagcauuuaaucaucucucuuccaagggcagccgcccgacuuagggcacgcuggguuuccaggccuccagccccucccccuuucccuugccagggacaugaaggcuguuaggucagagacacugaggcgauuuaaucuaaucccaugucaaaauggcugugugugagagagacagaggucuuaaaaucccuacaguggucaugcauuuauuuaagguggcaguagacagaaacucuauguagaaaacagcggaauugggguuccaaggcaugcgagguuaugaaaugacucccaucauggccucccucuccugugcuucuaagguguguggcuguccucaccaguuacucaucccugggagcuuuggguggggaccauuuccucacccagguguggccaaauaugcuucuucccugucugggguggaguacagaagauggaaucuuucaaaaacagcuuuauuugggugagucuugaauauaguauuuuugaagcugcuuuuuuucugggcuggaagcucuuguuccagaacagccucaucacccuaaggcucacccaccuuaaucacgcagucccuagaagggacacaaguuaaaucuuaguaagcagguuucauucaugguaguagaaaacauuccagcaccugcugacugcuggccacucaaagauggagacuuaauuccucccuuaaggaaucuacggucuccuuggggacaagacauacgagcagugaggaugaaugaggccgcugucuccaaggagccuguacagggagcagaggaggagcaucggagaagaggacccaagauggggaggagagaggcuggggaggagcccccuccaggcagaaggcauggaggugugugcuuggagaaccucagucaaguaguucaucuggcuggcgugugaagugaguggggauuaguggaucaccaggcuuaacugaacaacaguggccgacgugaagaguuuaaauaccugcaaagggguuuggacuuuauaucccgugggccacuagaaaccacugaagaacugugaaggagaacagcaagaucaggucagauguucagaagaucauucugaugauggcaguaucagccaauagauagauuuuugcauuagaaccuugcuucauuuauucuggggaaaaucuuccgugauacuaugaaaacuauuuuaacaauugggcaugggcccacaucauaggaaacccaaacacaucacagccagggugaaagaaauuuaacuuugacaauucuuuuaguuucuauucacaccagcccuaacccagaugguugcucacaguuaguuagaaaagaucucccugcacacuguagucacuguauuuguacagcaagggacuuguuccccaagccuggagcuuuuggaacugaauggagcccagaggcaagagcagugaaaugaggcugaccuuugcuucugguuuugcuugcuacuugccaguauguggguucccuggaggaacacacaggugucuuggcuuugccacugggcauuuugggugauuucguuaacuuugccuguuuugaccagaagagagccugaucgugauaggaggaggcgggggacugacgggguuauacaaucuucacauauauauacacucagucccaugccuugagucuagaggcuggggagagggcccagcugcacguugguugaggccagcaguacauggcccuugaggcuaugcugauagcaacuuguggcacacuuuguacuucauacugugaggaacaugaaauaagccagagccaggccugaucuugaaagaacccucugucaagugggaaggccuguugcagacaugcaucaacuggcccagcuggcuuauccauggcugucccugggccuccugugaauccagaggaggcugcuccagcauugauaaggcugggauggggcagguuccacaaggagggaaagcucaccccaguguaaaaggaaggagugggggauaagucuaucucaugaauaaccugagcaaaggcccaaaagaguguggcugauagauugggggaacugagaguagucuggggguggggggcaccuagaggacagggcaccugugagagagugagggagaugagacuggaaagauggaccagggcaaaccacgaaaggccuugaagaccaugcuaaaucauuugaacuuuguuacaagcuuuggaaaccuuuuaaaaaccauggaauuuaaauguuugagaugaggggaguaacauuauggaaagauauuuuggcugggugugguagcucaugccuguaauccuagcacuuuggaaagccgaggcaggaggaucacuugagcucaggaguucaagaccaaccugggcaacauagugagaccucgucacuauuuaaaaaaauaaaaaauaaauaauaauaaagaaagauaauuugagugacugggaaggggugaacugaaagagagauuaauuaaagacaguuaagagcaauuugcaaagguuuaguugaaagaaauugaagcccacaguuuuguaggccaaggccuggcccuucugcgugcuucccccaugcccacgugcacuuggaggcuggccucucuccuccuccuuucaggccugcauugcaagugugggggcgacuggccacgucuuccauuucggugagggcacaccagaggagccaggguuucuagugaugcgucaccauaacagcaagucucauuucaugaagucucacugcaucaucaaaugcuuaccccuuaucccuaaacuggcaaaacuuacucuuagaaaaaaguuacauacaauuuaacauuggaaaagaaaaucuuauauuugauuuuuuuugcauuagaaaauauuuugacaacccuuuuuaaaauaauuuuuaucuucaucaaaguagccuaugguuuaaaugucaaaaagaacuaaaaggggccucucugggucaguuucucaauacagugggugaaccucagaggcccagucagcaaaggucuuugggucuggauguugggguuggucuaaucaauuaaauucaaacuuuccacucauucucauuuuuagccucaucccucuuucugccguagcuaggccucuaugugcugagcccugugugagcauaggaguugccccuuccacuucucuguucaaucagaaccauuucacauuugcuuugcaucuucccaaaaaauguugacaucccucgguuauauccuuuuuuccucauucacuguaauucuaguuucagaaggaagagagauugauguauauguuaguuacugccuuacugggaauccuuuuuuuuaauguauuaucagcuuucccuuuuuaggcaggacuaccuuuauggagguuaugugcuucuuccuuuaagccauccuuucuacucugaaauaauagugauauuagggaguagcuggggucuuuuuuuuuuaaguugaccccaaaauguguuuuuacauuuuacuggugugugaaaucuagaaaucaggaaacaagugaccuaggcuuuaaaaauaaauaaauaaauaaaauaagcuugacuaugaaggaaggcacauagacggagcaguggccagaagacaggauaggagagggacaagauuuuucuuuucaagcugagagagacuuaagcauaggcagaaagaggguugaagaaggcaguguagccaaauaucaaagaaaaauaaugguggccuguucugagagggagaagacaggccggggacauucacaccugacgggccugugcuuccuagaugcggaggcaggcagggcccucucacggcaagcugggaaggcccuacccuaaggcauguuuccacaauuucucuaaacuuuucuuuucugauagucuguuuuaaaaaaaucaaaauggucaggguuggugguucacgccuguaaucccagcuauucaggaggccaaggugggaggaucacuugaggccacgaguucaagaccagccugggcaacacagcaagacuccaucucaaaaaaaaaaaaaauuauauuagccaggcaugguggcacacgccugugguuccagcuacucaggagaccgaggugagaggaucacuugaauccaggaguucgagguugcagugagcuguggucacgccacugcacuccagccuaggcuacagagccagacccugucucuuaaaaaaaaaaaaaaaaaaaguuaaaauggaaaaaaguugauuuccuagaaguagagaguagaauaauaguuaccagagucuggggaaggguuggggaggggggcaggagagguuggccagcaggugcaaaggaagaauaaguucugguguucaguuacacaguagggugacuguagcgaauaacaauguagucuguguuucaagauagcuagauuuugaauguugucaccacaaugaaugauaaaucuuuaaagagauuaauaugguaauuuucuugauuugaucauucuacaguguauacaugcauugaaacaucacauuguaccccauaaacaugaacaguuacuauauaucaauuauaaaucuuaaaaauuaaugaaaaaaauuuuaauggggugggaaagagaugucuuugugccugggccauggguaugugaucaccugaggcuggugaccacgauaccucaaaggcaagacuugggugcccccguccagccagcaucugggaacuugagccugagccccaccaacggucuucucuuugucucuccaggccugguccagaucccugugagcauguaccagacuguggugaccagccucgcccagggcaacggaccagugcagguggccauggccccugugaccaccaggauaucagacagcgcagucaccauggacggccaagcuguggagguggugacauuggaacagugacauacagccauauuauggcaucguuuucuagucuacuucaaaauuuuuuacacguuugcagaggugcaaucaaauggaauuaagucucucgacuuuggaaggaaaguuuuguuaaccuuuuuuuuuuuaaaaggaagaaagcggauuuuggaauugcauuuuuuaaagcaccacucuugauuuucugggauuggugaagaaacugcauugucaauuucacugucccaaaaaagccaaauuguggcaggacuucuuucugcggaaauguguguguauacuuauguguguguaugugugagugugaauauauguauauguguacauauggacauacacauuuacauauauauaaaguauauauauacauauauauauauauauauguaugaaacccgcauggaauuaucuguaugaaaucaaggugcgcuguggaaacaauaauucacccaguuuagugggugguaggguacguggccagacacagucacccaguuuuuguucauaccagggucaugcguugagcuacugacaaacucaggcggaggugaccaugcccuucaccaaagcugccucccaguggccacacagaacucucccugcuggacucaccugaggaaagaggcuccagcauggggugggucagagaugugcuugcaagguccagggacugcguggucugccagcugagaugcuccucgggcuggcccaggugcugaccuugccacaggcagaugaaugucuugaaagcucccgggccucagccucccaucuccucuccuucccaggaauccuugaucucaugacuauuaaaauguugcucugguuuuaaggucaguccugaauugcucguauauaugaacugaagguaaccgaaguauuagggguuugaggagugcgugcguguaagugugcuugugugugugcgugcauggugggggagaggaugggaagggggcgggggcaguggaagggaaaggaaggaaagaaaaaucguccuagaccaggauacacccgugggagcaauuuucucuacugucuguagcuucacagaggaggcgcuggaaugaacaagaagagacaucuggucuguggccacagcacccugaacgccccugaucuugugugaucuuggaagcuaagcuugguugggcccggucaguacgcggaagggaagaagggacaccuggccauagaaaacagcugaggguguuugcuguguuccuggaucaggcccugcuucagaagggacuccuggaggcccauguuccuugaugcaaccucguggcccaggccgggagcagcuugccuccucagagguguugacuaucuggguguucuugguaaccguuaacucugucuuucucagcugcaagcccugagucuccaguagcugaauucaccugacuuuucaacaggccaaaucucugaaccuugaguacagggacagcuccuccucccuccucccagcucuccccaugugugugaugguguauuuaauguguuuuuuuaaugcgacauuaaaagauucuccacgucuugcucaaccuuugagagaaguuucagauucuuguauuugcuuguuuuauauaaaacuaucuaauguucuuuauauguucuuuucuguacguaauggggggaggggagggaaauuuacauauaaauaguccuaguucuacaauuuguuauuuuuuuaauuauuauuuuuuaucgucauugugaaguuguccagggacuuuaaaguccauguuccuuuguggugaaauaaccuccaaauaguuugagaaguugccaagacgaagaaaaaagcaaaaccccaguagcagagcauggauucuguguuguuucccauucugucuuugacugccucauucaauaaauaguuaaaaauguggcaacaggaa

SEQ ID NO: 191591 - RNA, 122211 nt, Homo sapiens
gggaggccgacugagcaggagucguccgcuuauaguggaggcugcuaggagccggucagagggugaguggggagcaggcgagcgagccacagcaggcaggagggagcgucgcgcggcgcagaggagcgccggggcagggccgcggcggaaccacagccggagaggggcagcccgagccgggcgccgcaggguccccacccccacccggccggacagugcccgguguucccccgugcggggggcggcggcggcggcugacgggaccgccgggaccgcggggguguugccaccuccaccgaggagccggcgcggccgcgggcuccucagagccggggccccgggcccgugacagacgggccgaggaagggagagaggcggcggcgacaccaugucaucucccaguccgggcaagaggcggauggacacggacguggucaagcuguauccuucguggaggggaauucgggcuguguguggggggcgguguggggaugcccagggcacccccggaaccacugcaagggcccuggggcacuccaggccacuguccgagacuccccuccucccccagugccuacggcggcuccuuggcaccucccaggggccgagagccuuuucagcucgccuuuucuccgcagcaccccgaaauacgcguugcugcucgcucuuccuguauccccagagccugugacuuuccuccgcgacguuuggacucccgagacggccuuuuuucuuuuugcacgaccagucgccucacucucuaccaccgagcccauuuucaggguuucucucuccuguuugcucgcuuuggauuuagggaaucaaggcagaaauucccgagagggaagccuuucuccguuucuugagaugcccccauuuccuccaaccacaaugcugcuugaacuggggucacucaagcgaccucuuuuaucccuaauuccuuucuauauuaggaagagagucuccugcucagggcccccucuucuaagaaagagcucuguguguuuucagucagucccuccuguuaagcuuucugguccccgggagaacccuacuguuuuccuuuccacugacaaagccugucccacccauaguuguaugugaugaagacccccgggcccuccagcaagccacccuccauauuguggguaugacagcuggggaaagaggagcuccuggacaaaauaaauagucccuggacuggccacuugggcaaaacuuccucugugagggucagguucuugggggaauacuugcccugaugucgccaagugacacccuuuauuuucugcccccuccccccaacuuuaugcacucuggagguugcagugggaaagcuauaacugauaagagcccuucaggcagugguuuugguuggaguccagacugauuauuucaggaccagcuagagaaauucgcgaagguuccugugacaaaucgagaauuuuuuuuuuuugaaggguaguuuagaggguagggggagcccagaguucugaacagcuaguccuuggggaggggggcaagugggggcuuagagggugguaguguggaacacaguuuaaaaguccugucuccuguuucucucccuccuccccauccccccaccguuucccccuguugcaggguuuuguuuauauaacucaaguuguuuggcuaaauucuucaggugaauaccuuuuuucuuccuuuuauuuguugcuguuuuugauugaguguuuuaccucuuuguagagaucagugguuauugucaaaaaauucaguuagggaauuugcugaaguuuuaaaaaaguaguuuuugcauaugguuuggcagugggggaugggagggaaguugucugggcaagagauuuuuaaaaaauaaucuuuucagaaauaagguguuuuucuccuugcucagggaaaacuugguuagaaauuaggagcaguagauagacuucuaaguuugugguuuggaguuuagaauuuuugggggagugggagauuagagcggagcaacuaauaaaguauaguguacccaauauauguucaggcgcaagugaaaucaacucuuuaugagcuguuuguggcugugauuguuuuguaaaugugugaaugauaccaguaauguuggcuuuucauaaggcugcaggaaaacuuguaacuaugacuguguguacauuuuacacaaagcaguuucggguuuuauuuuuguuuagaaacuaggaaaugacauaguggcagcaucugaguuauuuuuaucuugaauugagaguuacugucacaccuaaugcgaauuucuaccuaauguuuaauugggauggaguggggagacaauuccagcuguuugugaucguugucagagucucaaauuauguacauagacauauuuuuaaaagauugaggauaaagaggggggccuaacuugaccugaugccuuuuccauacagugccuuuuguucauuuaguaguuguggcaucuagaaugauuaccgcauuuaggagucggggugugggggguggagagggagaggaaaacagacaaagaacagcagggugucuuuuuuuucucccccuaaguggcuuauuucauagcuuauuuuuaguagaagaugaagaaaggcaaagaugcauuggccuucuguucuuuccccaccuuccuuccuuucugacaaaagaaagcagaggcgcuuuaaaauuguagaucugagauaggaggauaacaguuucgagauuuaaaagccagagguuaucuuuguuucguguuuauuuucugguauaauggaguuuggaaguuaaaauguuucggauuuccuuuuguguguguuguguaggugagagauuuuguguccuccuuucucuguugaauucacagaucaguaggcccaaauggagccaacaauuuuugaguaagguauauuuagcagaaaauuuaaggaaaaauuccccagcccucuacuaaaaugaguacaauugugugaaaaggcuggggguugagaaagaugguggagaggaaguaggaagaaaaggucugaaggaaugcacuucuugccccccaugccccuugaugauuucuuugguguggggggcgauagcugguuuccuugcagucuccuguuucagcccauuuuuggaugucuccugagcguaauuauaccaccacgauuuacagccuggcagggaaccuauauaguaggaaaguagcaguguggggguagggagagaagaggauguguaacuaauuggccgcugccuuccaccaccucgcucgguucuuuuggagacaccgucucugguuguuguuuggagucagugauauuucuuuugugacggguugguaggagagcugacucccaaguuaugcagggagugaguguuuugcaccaaugcacuuaauaaucugcugggugauuauguucugaaacucugacucauucauuguuucucuucugauccuuugcuaaggguugugcaaaccuccccaggagccuagaaacugauuuacaugacuuuuggauccuuuaggaaugugucccaguaaaaaaaccuugcaguuagcccagauccuauggaauagucucgaauagugcggccauuuguuugcaaagucagguagauuggugaucugugcugcccagagccuggcaaccuuugagguuuccaccuccaaccagcugauuauuuagauugucugagagcuggggcucuggugaccuuaaagcgugauuugcccuaaaggaauaucgguuuaaguucucccugguggaggaacaaacagcucagauuacacggguuuccuuguugguggggguuacucgucucacccuguugcacagcccuggugauccuuucaucugugaaccaguggccccugcugaaggcuagagcugcuuguuuuggaaaagcguaugcaggcaaaaggccgcaggcaccgcuccucagcgcucauuggccgcccuguuacuacccggaaaaggaggaggggaggagcuaccaaacagcugauggaguaugugacaagagaguguguuuauauacaaaagaggugggggcuggggaggcccucugagugguguuacaggaacaaguguguuuucgagggguaaaaagagaagaggaaaaccugaccuguuagaguacaagaaauguuuagaaaaauuaagguuaaaucagaaaaguagaucggauaauaauggggaccggcauacaccauauguacaauuuuguaacuuacaauaccaagaguuuucaaugauucuucuuuucagagggaguucaguaauaggaucccccccuuauuuauuuuuacauuuuuuguagagaccgaggucugacuagguuaccaggcuggccucccaacuccuggccucaaaucuuccuccugccuuggccucccagagugcuggaauuacaggugugagcccagugcaccuggcccagggcaugccacuuuaaaugcacuuaacugacucauuugcagggauuccaaaguauggcagaaaugucagcuucccuuaagaaagcgucaagugugauagaaagggacggugucuuacauuaaaacggccugaguuaauuuuacagaaucguuggugucugcuuuaggguuucagaagcuuucucuaacaaauucaaaaccucagauguggccaagugugguggcucacaccuguaaucccagcauuuugggaggcugaggcgggaggaucaccuaaguguaggaguuugaggguccagugagcuaagaucaugccacugcacucaugccugggcaacagagcaagacucucuuaauuaaaaaaaaaaaaaagcuggcacaguggcuuaugccuguaaucccagcacuuugggaggccaaggcgggcagaucaccugaggucaggaguucgggacaagccuggccaacauggcaaaaccccguauguacuuguacuaaaaauauaaaaaauuagccaggcgugauggugcgggcuuguagucccagcuacuugggaggcugagucacgagaauagcuugaacccaugaggcggagguuguggugagccuaaauuacaccauugcacuccagccuggacgacagagcaagacucuuaucucaaaaaaaaaaaauccucauauguuuggguacuugcuuugugccagcauugugcugggaguuuaguagugaaaaauucaguauggguggucauggugcuuaugcaauuaguuaaaacuuuuuuagucggaaaggacaggcuguguuaggucauugcuguguguagugccuuuuugaguaacuuguauuuacuuagaguggacuuuucaaggaauagaaagguuaaaaugaauuuugugugcuaggauguauauggggaucuguacaccuguuuaaaaaaauuucaaaacuaaaauauuaaaauauguagccauuugucuuugacuuaacuuugguauuuugcuguuaaucaguaguuacucuaucccuaaguuaguagucuuuguuacucuuuaauuuguguucaaaggguagacaguucccuaaaucuuuuaacuaguucuagugucaauugggaaccugugguuugccucuuuauuuccaguggacucuguuuuagugagaugaugagaugaaaguuggcacagcuuuauggucuucaagcuaaaaguuaaagauuuggcaacucucaguguucugaauuugucuucccugccuagauuuuggugacaaauauaacauacugguacuuauuuugguuaggcaggaaccuacaugaguaagcauucacagcuucagaacaucugauuccugcagugcaguucuaguaaauuacacgcaagccuaaaaauucagcuuuuugggaaaaaauguuucgcagaugugacccauaaacgucccuccuguauuuguguauguauguuagaacaaccuaaguuuguugguuuucuaguguugcaauuuucuuagccccuugaccugcauuuuauagauauauuuaaacauugguauucuuuucagucuuaacagauuugaugguuccaagaaucauuggauuuuuaggcauguaauccagaccuuacauuacguuauaauguuugcaacguaauagcuuuuuaccuguagaccuacagaguguaccuguuaguaaaauacuuaaaagaacuuaguuggauuucaaaaguaaaaagauaauugagaaaaacauagguuacaagaaggaaaaccagucaccuguaauccuaguucuuuaaacaguaguucucaaacuuuaguuugagauugcaccacugcacuccagcccgggggacagagcaagauuccaucucaaaaaacaaaaaacaaauaaucaccuggagaguuuguuaaaacagguuacugcauaccacuccuggaguuuucuaauucauugggucuaggguggggucuaagaaguucgcagaugaugcuucugguccaggaccacuguuuaagaacuguuggccuuaaauguuaaccuuauggcuuuuuuccuauaucuuuuauucuccccaggauguauuguuuucaaccuguugaucauacuguaugugucugcccuguuuuugcuuaauauuuuugcaacuguuuuucccaguuaaaaauaaugacuaggggccgggcgcgguggcucacgccuguaaucccaacacuuugggagguugaggcagacaaaucaugaggucaggagauugagaccauccuggcuaacaugguaaaaacccaucucuacuaaaaauacaaaaaaaaaaaaauuagccgggcgugguggcgggcgccuguagucccagcuacucaggaggcugaggcaggagaauggugugaacccgggaggcggagcuugcagugagcagagauagcgccacugugcuccagccugggccacagagugagacuucgucucaaaaaaaaaaaaauaauaaugacuaggcugggcacaguggcucaugccuauacauccagcacuuugggaggcugaggugggcagaucaccugaggucaggaguuugagaccugcuugacuaacgugaagaaaccccaucucuacuaaaaaauacaaaauuagcugggcgugguggcgcaugccuguaaucccagcuacuugggagguugaggcaggagaaucaauucgcuugaaccugggagguggagguugcggugagcugagauugcgccauugcacuccagccuaggcaacaagagcgaaacucagucucaaaaaaaaaaaaaguagcucauguaauaugccaucccauggcugugccauugauuuaauucuuugccauuuuucucugaugaauaagauugaaauuaacaucuuugugcauaggcuuuucuuuggguuauuucuguuuucccgaaaugggauucuagaucaaagaagguaaacauuugaauuaaaauauuuaauuaaaaaucucagagcccuacacucagcgggcucuuguuuuguuguguuguguuuuaguugguaucguuuuggcacugaaauagccuggcauagugauuaaagaugaauucuaauuuccucauuguuuaaacuuugauguuuuuugugauaauggugauccucaauuuaggcauaauuuuguauucucagagugcauacugcaagucgguagguuaaauauauuuaugagcagauagaucuaacaggaacuguagaauuaguuuuggcaucuuggauucuuuuuuguuauugagguauaauugacauacaguuaacuguacauauuuaaagugauacuuuugauaaguuuuaauuuuauguaucacccaugaagcuuauccuuaucaagagaggagacauauuuaucuucccccaaaguuucuuguggcccuuuguaaucuuucccucccucccuuccaaccauugaucucauuucugucacuguagauuauuuuacauuuucuagaauuguauauauaagcggaaucauucaguacauacucuuuuuguguggguucuuucacuuauaauucugagauucacccauguuauuuaguucauuuuuuuuuuauugcugaguaguauucuauuauguggauauaccacaauuuguuuaugcauucaccucuuaaugcuugguggcauuuggguuauuuccaguuuugggcuauuaccaguaaaguugcuaugaacauuguauggauauacgcuuuuuuuucucuuggcuaagcuagaucaugugguaggguuugcgcaugcgcgugcgugcgugcguguguguguguguguguguguguguguguguguguuuugagcgcaugcgcacguguguguuuugagacaggauuucacucuguugcccagaugagaguucauggugugaucucagcucacugcagucguggccacuugccuggcuaauuuuauuuuuuuuguagagaugaggucucacuguuggccaggcuggucucaaauuccugggcuuaagugauccucuggccuuggccucccaaagugcugggauuacagauguaagccgcugugcccagccauguuuaacacguaguuugaauuuaauguuuacugaugaugguccauauuucacacccaaauaaaauugugacaacgguuguuucacuuguguguuuuguuuuguuuuguuuuguuuugagacggagucuucgcucugucgcccaggcugaguguaguggcgcgaucucggcucacugccagcuccgccuccuggguucacgccauucuccugccucggccuccugaguagcuggaacuacaggcacccgccaccaagccuggcuaauuuuuuguauuuuuaguagcgacaggguuucaccauguuagcgaggauggucuugaucuccugaccucaugaucugcccaccguggccucccaaagugcugggauuacaggcaugagccacagcgccuggccucacuuguguauuuuaaaggaaucauguuaaauuacaugcucuuaaagcacugauuuauuuuuuauuauuaaccuuauuuuauaguauaugaauuuuguuaauuuuuuuaucaauaaaacaaauuuuaccacaaugauugugauaccuuucacuugaauaaugauuuaaacacuuuaucuuccuuuuuuaaagacagaaucagucucgcucugucgcccagacuggcucucugcaaccucugccuccugaguucaagcgauucuccugccucacccucccgaguagcugggauuacaggggccugccaccacacccagcuaauuuuuguauuuuuaguuagagacaggguuuugccauguuggccagguuggucuugaacucuugaccucaggugauccgccugccucugccucucaaguacugggauuacaggugugagccacgaugccuggccaaucugguuuuuuguuuguuuuuguguuuguguuuuuagacggagucuggcuguguugcccaggcuagagugcaguggugcgauuucaacucacugcaaccucugccucccggcgcuuggccuaaagcauugauuucuagcugaauuugguuaaagcugauuugguagcuacucuucucuccccacccccauuugaaauuaguaaauuaaauuuuuauugugaaauauuuuuguuagccugagcuacauggcaaaagccuauuucuaccaaaacagauaaaaaauuagccagguaugguggcaugcacuuguaaucccagcuacucugggggcugaggcagaaggaucacuuaagcccaggaggcagagguuguggugaguuaagaucaugccacugcaguccagccugggugacagggcaaggcccugucuaaaaaaaauguuuuguggcccuuugaaauuacacuuuaggaaucuggccggccauaguggcucaugccuguaauccuggcacuuugggaggcugaggugggcagaucaccugaggucaagaguucaagaccaaccuggccaacauggcgaaaccccaucucuacuaaaaaugcaaaaacuagcugggugugguggugcacaccuguaaucccagcuacucaggaggcugaggcaggagaauugcuugaaccugggagucggagguuguggugagccgagauuaugccacugcacuccaaccccggggaacagagcaagacuccaucucaaaaaacaaaaaaaaaaacacauuacacuuuaggaucauagucacaaacagcaauuuuauuuuuauauuugcuaguaaggcucuauaucuuugugaauagguaagcacacuuuuuguugaugguauuauuuucuuuguaaaguauugauaagauuuuuuuuaacauuucuuuagcauuucuagugaaguuuacagcaguugauaaauauuucuggagcacucuguugaagucugaauaauaucuucaauuuucacauggaauaaacucaggugaaaggaacuaacagcagcucagugacagaaugggaaacagacuauaagaguuaggauauccuuugauaucaugcuuuccuggaauuuuugugugugugagagacggaguuucacucuuguugcccaggcuggagugcaauggcaugaucucggcucacugcgaccucugccucccagguucaagcgauucuccugccucagccuccugaguagcugggauuacaggcaugugccaccacgccuggcuaauuuuuuauuuuuaguagagaggugaucccccugccuuggccucccagagugcugggauuacaggugugagccaccgcgcccagccuggaauuuuuugaagcuuuuuuuuuuuuuuuuuuuuuuuugagaccgagucucacacugucaccuaggcuggagugcaguggugugaucacagcucacugcagccucgaacuuccggauucugaacucaauccuccugcuucagccucccgaguagcugggacuacaggcgugugccaccacaccuggcuuacuuuuguauuuuucguagaaacaggguugcgccauguuggccaaacuggucuccaacuccugggcucaagcggucuggcugccuuggccucccaaaguguugggauuacagggguagccacugugccuggccuuaaguuaauuuuuagugaaauggugcuuaaaauuuuuuuuuggcaucuuaagaguuauuugauagguuauuggacacugccauaauaaaauuagacauugauuuguaauaguuguuguuacauucuuucugauaaauuauaaacaauuuaucuuauggacauuuacauguguguugcuaaaaaaaaauuaaagcuggauucaguggcucaugcuuguaaucucaccacuuugggaggagugcuugagcucaggagauugagggugcagcaagccaucauuaugccacugcacuccagccuggacaacagagugagacccugucucaaaaaaaauuaauauuacugacagcuggaacuuuuaguuuggcuaacaaaaaggugaccuggcuuguaccuguuuuaguuuggagcaaugauaguauguuuggugaguagacuguuuugguauucagacacaggaauggugcccugagcauauaaauuccagugucuuggccagacgcaguggcucaugccuguaauccuagcacuuugggaggcugaggugggcagauugcuugaacucgggaguucgagaccaaccagccugggcaacauagugaaacccugucucuacuaaaauacaaaaaauuagccgggcauugcuugaacucaggaguucgagaccaaccagccugggcaacauggugaaacccugucucuacuaaaauacaaaaaauuagccgggcguugcuugaacucaggaguucgagaccaaccagccugggcaacauggugaaacccugucucuacuaaaauacaaaaaauuagccgggcgugguggcuugcgccuguagucccggcuacuugggaggcugaggcaggagaauugcuugaacccgggagguggagguugcagugagcugagauggugccauuguacuacagccugggcaacagacugugacuccgucuccaaaaaaaaagauuccaguuuguuauuuucuaugcugaaguguaauucgagugcauuguagaaacuuuugaaaacacaguagucuguugagaggcuguuguugcauuagugauucucaauuggguaucacauuggagaagaauuaagcuuuugggggcccagguacuaugguuauuguaauuucuucucuguaccucaccagaugcuuggggaaggugucugguuguuuauaggcuggugcucaaggggguaucugcccaugaccaguagaacccaaauccucaagagccuggggaagcccuacauggcagccauaugcuuaagagggaaggaggauccuuuuugccucucccugcuuuguagguaucuaggacguuauguaggcagugugaauaguugcugcugaucuucugaccugucccugcagagaagucagagagaggaguagguagcccuugugaagggagaggcuuggcuggacuuugccauucucuggaagacuuugccauucucuagaagauaggcaugguuggcgggucugucaguggacucaaaaaaggcaccuguucuguagcacuuggaggauccauauuuaggauaucaauuaauugagaauguaaucuuugucuuugguucaaucuccugguuucuaacuuuuaaaccauuuuuagggaagcauuauaugugaagguaggagauacucccuacauacaaaaucauguuauuaauguugugaauuaugcauuuccuuuuuaguauuaggcaacuuuuuuucauauaucaaguuaucauguacacuuuucaagguuuuuuggauuauaaaaucuuaguugagguaauauaaauagaaaacuagauacagagugcgugucugguuuguguuaccucagaagcaauugggcugucacuuagccuagcaaaaaguaaauuuaguuguuuuguccaaagggugccaguauaacuuugguaaucuggauuuugcuuuucuuucuuucuuucuuucuuuuuuuuuuugagauggagucucauguugucgcccagucuggagugcaguggcuccaucucggcucacugcaaucuccgccucucagguucaagcgauucuccugccucaggcucccgaguagcugggauuacaggcacgcgccaccaugcccggcuaauuuuuuguaucuuuaguagagaugggguuucaccauguuggccaggcuggucucaaacuccugaccucgugauccaccugcuuuggccucccaaagugcugggauuacaggcaugagccaccgugcccagccuggauuuugcuuuucaauuugaugacuauguugcauagacaguugcugauaaguugauuaauuuaaaaauucagaauuugguuggacauuuccauuguagcauuuguauguagaagguugauugguuaaagucauaucaguaagagaucaccaagaguaauauauagauggauauaauguuuucauggucuuacugcuggauguuuacuacccuuuugcuauucuugaaucuaaaccuguaaauaaauuagugauucuccuuggcagcaaagcuuggaacuauauaacucuuuuaauuguauuccgaaagaaggaaacuggguaacaaaugcucacuuucgcugguugcaguggcucauuccuucagucccagcuacugggaaggcugaagcaggaggauugcuugaguccaaggcuguaguguacaaugacugugccugugaauagucacugcauucucccaccugagcacuauagugagacccugucucuaaaaauuaaaaaaacagucacuuuuauauggcauuugguucucacagcugugaauuguacuugaucagaucauuaauucaaacuagaggccgggcgugguggcucaugccuguaaucguagcacuuugggacgccaaggcggauagaucaccugaggucaggaguucgagaccagccuggccaacauggugaagccccaucucuacuaaaaauacaaaaguuaguugggugugguggcaggcgccuguaaucaaagcugcucgggaggcugaggcaggagaauugcuugaaccuaggagguggagguugcagggagccgagaucgcaucacugcacuccagccuggugacagacugagacucugucucaaaaaaaaacaaaaaaaacaaaaaaacaaaaacaucaaacuaagccuacaaguacauaaucuugugaggggaaucuuggacaguuugggucggcuuuguuuuuuuuuuuuugagacgaaguuuugcucuuggcgcccaggcuggagugcaauggcguaaucucgacucaccacaaccuccgccucccggguucaaacaauucucagccuaucgaguagcugggauuacaggcaugugccaccaugcccagcuaauuuuguauuuuuaguagagacggguuucuccauauuggucagggugguuuugaacuccugaccucaggugauccacccgccucggccuuucaaagugcugggauugcaagcaugagccagccuuuuuuuuuuuuuuuuuuuuuuuuuuuugaaugaggcagucucucucucuguugcccacgcuggagugcaguggugccaucauggcucacugaagccuugaccuccugggugcaaagcaaucccgccucaucccccugaguagcuggaacuacagucacacgccaccaugcccagcuaauuuuuguauauuuuuguagagacaggguuuugccauguugcccaggcuguucuugaacuccugaguucaagcaauccucuugccuuggccuuccaaagugcugggauuacaguugugaaccauugugccuggccauggauuuuuauuacaaauuauauucaaauagaugaaaacaggagggaaaagaauuuucaguauguguaguaguuuugacaggaguuuuagccuuuuaucuugguggcugauauuagauauuaacguugcucuuaaguguacuuaagcacacuaaaacauugaacacaauauguguuugauaacacaauuaucaagggaacugaggauaaaagcacucaucuuugcaucacaauaugacauuauuagcaucuguuaacuuuacaaaccugauucauuuaguucuucauagccaccaucuugauaaugaauaaagaaaaaacaaaugauguauuuugucacucuauucauuuuuaucuauaaagauuuaaaauaccuuucuuuugaguuagguugguuuuaugguuggaagaaggaaaggagguagaccuuugaaugccuugauugcugcccauuucucuaggcagugaagaaaggcagcuaaagugcugucucugauuaucaaaugccauauaugugaguauaccuguguuguuugucaugcuguugugaauacucacuugcuuuuuuauccacucaucuuuuuuauccacgagcuccugcauuaaaguaguuaguaaccaguucuuucucuuggaguaauuaaugugacuuuucccuuguuugagauuuaguuaagaguuuuauauauaacauauaaaccaugauauaucugaaaaacuguauuugugguucauaaagacuguaauuucauuucauuuucauaaauuguauguuuuuucuuuuuucuuuuuuuuguuuugagauggagucucacucuguugcccaggccgaagugcaguugugugaucucggcucacugcaagcucugccuccuggguucacgccauucuccugccucagccuuccgaguagcuggggcuacaggugccugccaccaugcccggcuaauuuuuuuguauuuuuguagagacgggguuucacuguguuggccaggauggucucgaucuccugaccucgugauccauccgccucagccucccagagugcugggacuacaggcgcgagccaccaccacaccuggcccauaaauuguauguuuucaagucuguguguuuuuuuuguuguuguuguuuguuuguuuguuauuuugauauggagccucacacuuguugcccaggcuggaguauaguggcgugaucucggcucacugcaaccucugucuccccaguucaagcgauuuuccugccucagccuccuggguagcugggauuacaggcgccugccaccacaccuggcuaacuuuuuuuuuuuuuuuuuuuuuuuccuaguagagacgggguuucaccauguuggccaggcucuaggcuggucucgaacuccugaccucaggugauccaccugccuuggccucccaaagugcuaggauuacaggcacaagccacugcacguggccugaacuggauuaucuuaauggacauauguaucuuuuuauuugcuuaaugagaauuagaaauucuauuuuuuuuuuuuuuuugagauggagucuggcugugucacccaggcuggagugcaguggcgcaaucucagcucacugcaagcuccgccuccuggguucaugccauucuccugccucagccucccgaguagcugggacuacaggcgcccgccacuacgcccggcuaauuuuuuguauuuuuaguagagacggaguuucaccauguuagccaggauggucucgaucuccugaccucgugaucugcccgccucggccucccaaaguacugggauuacaggcgugagccaccgugcccggcuuagaaauucuauuuuuuguagaaucagaaaucaguuugugacuugugugcuuuuaaauugggcauauuacucacuugaaugaauuggauaaaacaugaugguuuuagucugccaguucuggcaguuuuauuucuuaaaugucauucuuaaaguguuuugucaguucugaugaaguucugauggcaucuuauuauuuaaaguuaaauuuuaauagguauuagagucauagauuuuagcauguuuuuauacuucgagaaaaccuggacugcaaauacuaguauuacaaagcaaugguggcuuuccgaauauaagggcucuuaguguggaaauuaauaaucauauucucucuaggcaauaauagcauuuguugccuuaaauaguagcuuaagaaguaauaaugcuugacuguacacuucauuaaugcuugacuguaccgcuucagauuaggagaguaaacucugguaacuuuguuauuauugauagaaaaaaacagaugaaaguugagaggauacuacuuuucaacugugauuaacaucaguuuuacuaguagucauguuuguugugugaaaaauagaauuaaaacaacagccuaguaaugucuguuaauccugcuuaucaauauaagauucguaaagaaaaauaaaaaugacuuaguagauuuuaauaucaguguucugguaccucucuacaacaauagauuagauggcauugcaucuuuucuuaaggugucagaauuguauuuacccuguuaauuuaaagaauagaauaagugcuguaaaagugccugauuuauggaagcuuuugucaggauagaauggcagcaugcuguuuucauuucaaaguuuuauguauuuaauuaccugaguuauauuuucuuuucuguuuuuuuuuuuuuuuucuuugagacagucucgcucugucgcccaggcuggagugcaguggugugaugucagcucacuaugacccucgccucucggguucaagcgauucuccugccucagccuccugaguagcugggauucaggcaugcacuaccacgcccagcaaauuuuuguauuuuuaguagauacaggguuucaccauguuggucuugaacuccugaccucgugaucugcccaccucagccucccauaauggugggauuacagaugugagccaccaugcccagccuuaaauuuauuuuuaaaaguuauauauuuaucuauauauauuucugcuucuauguauaccucuauauauacauauguuuauuuuuaccuuucaccucuauuuuguggugcauauauauauauacacacacacacacacauauacacacacauauauauacacacacauauauacacauauauauacacacacacacauauauauauauauacacauauauauacacacacacauauauauacuuuuuguagaaauggggucuuguccugucuguuuuugaacuccugaccucaagugaucuggcuaccuuggccucccaaagugcugggauuacagggugagccacccugacuguuuuuuaaaauuuuuauuuuauuuuuuuauauauauuuuccacuucagaauuuucuaagcaguugaaauuacuccuuuaaaugagaaaaccuugaugauuuuugguguauguguuuuuauuucagcuuuuuuuuuuuuuuuuuuuuuuuuaaagacggagucuugcucugucgcccaggcuggagugcaguggcaugaucuuggcucauugcaaccucuaccucccagguucaagcgauucuccugccucagucuccugaguagcugggauuacaggugcccacgaccaugcccgacuaauuuuuguaguuuuaguagagacaggguuucaccauauuggccaggcuggucuugaacuccugaccucaggugauccacccgccuuggccucccaaagugcugagauuauaggugugagccaccacuccuggccucagcucauguuuuuguuguucuuuuuuguuuuuaaagcaaggucggucuguguugccuaggcuggagugcaguggugcuuucucggcucacugcaaccuccaccucccaggcucaagcgguccuccugccucagccuccugaguagcuaggaguacagucgugugcuauaaugcccggauaauuuuuguaauuuuaguagagauaggguuucaccauguugcccaggguggucucaaacuccugagcucaagugaucugcccaccuuggccucgcaaagugcugggauuacaggcaugagugacugugccuggcuugucauugcucuauaauguacuuuucauucuaauacauuucacguuuauccuugcagcauuuuugcuuugagauguuauggcccacuuuuuguggguuaaaaaucuggaccacacaggucaguuaaaggugcugagaucagaguaaguccuuaucacaguggaucuggggcuaacuaugguuuccuaagcuuuugucccuuauagcuuugccuguguaguagaugcucagcaaacaccuguuaaacggauuagaauaaauuauauacuacuggguuuucaccaaguccuuaggucauuuuuagacuaaacuuuggcaccugcaauugaaacgauauggaaaucuugcaggaaaguguugaaucuuccuccaaugauggggaauucaauucuuuucuguguggaugucauuugccuuuuuauguaguguucauuuucccacauguaacguguguuuguuuucuuaaaugguccuaaaugcuaauaccuuauagguuauucaaugccguuuucagaugguugagauuguuugauuccugguguuuaagauaaaaggaaauuaagguugugcauuggggaaagaaacagcugaaacuugcuuuacuucauuuguaaaauagaauaccuuaaacucauccaaauuauggagcuuuuuaguacccuguuuuauaaguugcaaaguguuuccaguuccuccuuacaaauuuagaaguucuaaaagggguuuuccuuaauauuugauacugucaacuucuuaguuugcucaggacuucauuaaggaccuuuauguuguguuuauuuuuaccuuucaccuguauucugugacaaaagaggacuuaagaacuacuucagcagcucacaccuuccauaaaaguauguggccuuuucuuaguuauucagaauaauaggaaagauacuuaaaccagauauuuaaaaucucauuuuacagaugcaaaaccugaaguuuaguguuauauuuaaauguauauacacauaaguauagcuuuuguuuuucuuuguuuguggacaugugcuuggugaaagaggaacagaauuuuacucuuuagguuuuugguaaguaacagagguucuggcacaggugaugucuggagcccccuagggauccccaagauacuuucaaggggaaugugaggucagaacuuuucauaguaauauugauucauuaugugcccuuuuugcccagccaacaguuuucugauguagauagacaguucugacaggacuuuuuuuuuuuuuuuuuuuuuuuugagacggagucucgcucugucgcccaggcuggagugcaauggcgugaucuuagcucacugcaaccuccgccuuccggguucaggcaauucuucugccucagccucccgaguagcugggacuacaggugcccaccaccacgcccggcuaauuuuuuguauuuuuaguagagacgggguuucacuguguuagccagcguggucucgaucuccucugacaggauuuuugauguaugaugaaauggugucaacauuuggaagaucuguguaagucagugaaaacuguuuuccaaauggccagugcaugacagaaaaauuaugccugguuaaaagauccauuaaaaaugcaaaguaggcugggcguggugccucacgccuauaaucccagcacuuugggaggccgagguggguggaucaugaggucaggagauugagaccauccuggcuaacacagugaaaccccaucucuacuaaaaauacaaaaaauuagccgggcgugguggcgggcgccuguagucccagcuacucagggggcugaggcaggagaauggugugaacccgggagguggagcuugcagugagccgagauugcgccacugcacuccagccugggcaacaagagcgagacuccaucuccaaaaaaaaaagcaaagugggcugggcgcaguggcucacacuuguaaucccagcacuuugggaggccgaggcaggcggaucacguggucaggaguuugagacuagcuuggccaacacagugaaaccccaucucuacuaaaaguacaaaaauuagcugggugugguggcgggcgcuuguaaucccuguuacuggggaggcugaggaguagaaucgcuuaaaccugggaggcggagcugagauugugccacugcacuccagccugggugacagagcuggacuccgucucaaaaaaaaaaaaaaaaagcaaaguagaacaguggauuuuaauauaagaauaugaaaaguucguugguacaauuuaagauuccacauugcaguuagccuuuacgagacaacugcuugucaauuuuggcauuauaucaacaaaaaauguccagaauuaucugaaaagucuguuaaaguacucuuuuccaauuacauucaaaacauaccagauucaauacagaagcacauaugaaaauccagcuuucuuuucuuaagcuggauauuaaagagaguugcaaaaugauuaaaaacuguucuuacuauguuauucuuuguuuuggaaauuaguuuuuuuuuucuuaaagaugauuuauauuuauaugcauaagauuuacuuuuaaaugaauuaauauuuuguguuucuaaaaugguaaauaacacacauagaaaagcucuuugaggucuucagguuuuuuuuuucuuuccccaagacagagucuuacucuguugcccaggcuggagugccauggcgugaucucagcucacugcaaccuccgccuccuggguucaggcaauucuccugccucagccucuccaguagcugggauuacaggcgcauaccaccacgcguggcaauuuuuuuuuuuucuuuuugagacaggguuuugcucuuguugcccaggcuggagugcaguggcacaaucucagcucacugcugcaaccugugccuccuggguucaagcgauucuccugccucagccucccaaguagcugggacuacaggcaugcaccaccacgcccagcuaauuuuuuguauuuaauagagauuggguuucaccauguuggucaggcuggucuugaacuccugaccucaggugauccaccugccucagccucccaaagugcugggauugcaggugugagccacugugcccggccuuguuuuuuuuuuuuuuuuuuuuuuuugugagacggggucucgcucucucacccaggcuggagugcaguggggcgaucucggcucacugcaaccccugccuccuggcuuuaagcaauuuuccugccucagccuccggaguagcugggacuacaggcgcguaccaccaugcccggcuaauuuuuuguauuuuuaguagagaugggguuucaccguguuagccaggauggucucgauuuccuaaccucgugauccacccgccucggccucccaaagugcugggauuacaggugugagccacugugcccagcuguuaauuuuuuuuuauuuuuaguagagauggguuuucaccauguuggccaggcuggucuugaacaccugaccucgugauccacccgccuuggccucccaaaguacugggauuacaggcguaagucaccaugcccagccgaggucuuuaauuuuuaagaauguagaccgcaugagguggcucacgccuguaaucccaacacuuugggaggccaaggugggcaggucaccugaggucgucgggaguuugagaccagcuugagcaacauggagaaaccucgucucuacuaaaaauacaaaauuagcuggucaugguggcgcaugccuguaaucccagcuacuccggaggcugaggcaggagaauuacuugaacccaggaggcagagguugcagugagccgagaucgugccauuacacugcagcgugggcaacaagagcgaaaccccaucgcaaaaaaaaauacagaguguaaagcgugcugagaccagaguguuugagagcuacuacuccuaacaaauguauauuggaagagaagucauauuaugauaaagucuaggaugugcuuuaauuguaaccuagcacaguuucuuguauauccguuuuuuuuguuuuguuuuguuuuuugagauggagucuuugucgcccaggcuggagugcagcagugcgaucuuggcucgcuguaaccuccaccuccuggguucaagugacucuucugccucagccucucaaguagcugggauuacaaggggccugccaccacaccuggcuaauuuuguuguuuuaguagagacagaguuucaccauguuggccaggcuggucucgaacgccugaccucaagugaucagcccgccuuggccucccaaagugcugggauuacaggcaucagccacugugccuggcaauguguuaauauaauauuugaaccagacuggauagaauuauucaguaaaccauguaaauacacauuuagcuaagaaggaauauugguggcgugugaagaugguaaguguuuuuaugucaguaaacagugucugguuuaucuuguauuuuauagauucugagaccuuuuuuucccacaucuuaacaucuuugaaauugagaugucuuaaaauggugauaagucauagucuaaugggcagcuuuuuucuuucuuggugugucauaaaauaauggugugucauagauguaaugaaaugugcuagugucucuuuuuguguggagaggagaaggaaacauacuggauagcaguucaguucuugagcuacgggauauggugcauuaaauguuacucuucuuuuuuuuuuuuuuuuugagauggaguuucacucuuguugcccaggcuggagugcaauggcacgaucuuggcucaccgcaaccucugccuccuggauucaagugauucuccugccucggccccccaaguagcugggauuaccggcaugugccaccacgccagcuaauuuuguauuuuuaguagagacgggguuucuccauguuguucaggcuggucucaaacucccgaccucaggugauccgccugccucggccucccaaagugcugggauuacaggcgugagccaccgugccuggccccuaaauguuacucuuaucaggcacuuaauugacucugggcaauugacagugcacucauuguuggaauauucuauucauaaagcaguuaucuuuauuucaagcaagaaaacuagauuucaaugcuagaauucaagucuuuuaaaacaaaguguaaaacucauauuuguguaucuuuuuuaauaugcagagccuuuuuucuguuuaaccauauuguugauuuucuccucuuuauauauguauauauauauuuaguuuuaauugacauauuuauggcauacagugauacuucuauagauguauucaauguguaaugaucaaauugggcauaucugucaccuuauuuaucacuucuuuguguugggaacauccaaaauccacucuucuaguuauuugaaaagacaaaauauuuguuuuuauuuauuuauuuauuuuugagacggagucucgcuuugucgcgcaggcuggagugcauuggugcaaucucggcucacugcaaccuccaccucccgaguucaagcaauucuucugccucaggcuucugaguagcugggauuacaggugugugccaccacacccggcuaauuuuuguauuuuuaguagagacgagguuucaccauguuggcgaggcuggucuugaacuccugaccucaaaugauccaccugccuuggccucccaaagugcugggauuacaggcaugagccaccgugccuggccauaaguuguguuuguuuuuuguuuuuauuuuuguuuuuuugagacagagacuugcucugucgccaggcuggaguugaagcacuucuccugccucagccucccaaguggacuacaggcacgugucaccaugccuggcucuuuuuuguauuuuuaguaggcacaggguuucaccguguuggccaggauggucuugaaccccagaccucaugauccgccugccucagccucccaaaguauugggauuacaggcgugagccacugagcccagccaaauuuuuuuuuuuuuuuuuuuuuuaauuuugagaugguauuucgccauguugcccagguugguuuuaaacuccugggcucaacugacccgccucccaaagugcuggaauuacaggugugagccacugcgcucagcuacaauaaauuguuaauuauggucaccuucgaaugcacacuaagacuuauuucucuuaucuaucuguaauuugguauuuguuaaccgaucucuggcuaccuccccaccagacucuaguaaccacuauucugcuccauuucuaugaaauuaacuuuuuuagcucccacguaugagugagaauaugcgauacaugucuuugcgugccugcuuuauuuuacuuaacguaauguccccuaaacucauccaugaugcugggaauuauaagaugugguuuuaauuuuuuuauggcugaauaguauucauauauaguguauuacauaccacauuuuauccauuuauuuguugcccacauuuuuuuguuguguuuuuauuuuugagacggagucucgcucugucagccaggcuggagugcaguggcgcaaucucggcucacugcaaccucugccuccaggguucaagcaauucucugccucagccuccccaaguagcugggauuacaggaguccaccaccacgcccggcuaauuuuuguauuuuuaguagagacgggguuucacgaucuuggccaggcuggucuugaauuccugaccuugugauccaccccccucugccucucaaagugcugggauuacaggcaugagccaccgcaccuggcgaaguugcccacauuuuuaaauuucuaauagguuucuuaaaaaaguuacugaauucuauuauuaacauuuuagugucucuguuuuauucuguauaaaaauaauaggaccauuacauggaguuaugaagauaguguaugaauaaaaagccuaggcauccuuagaaguacguuuuaaaaaggagaauagggccuuggaaaagcacagaguugagucuaucagagaaggcuuccugguggaagcagaaugucauagagacaggagauagaugagcaagagggcacucaugagguaugaggcgguugguagguuaucuugauuaaagaaucagguuguaaauaaguuacuguuaaguacauauguacuaguauguacuagagcguggcguuugugaccaagauuaugugggcugcuguauggagaaggggcugagcuuuuuaugaucugacacucugcaaccaguagggccauaccugauacuuuucuggaggugugaucacuuaucagucagccagaggaggacucuugguaaagaauuuacucacagguugaaauccaaucaugguuggcaggguuuuaaugaauuagaagacagugaauggauuuguggcacauuauaugagaaugauugagauaauuuuuugaaaugccucugcuuuuucagguggcucaugacuguaauuucagcgacucaggaggcugaggugggagaaucacucgaggccaggaguuucuuuuuucuuuuuuuuuuuuugagacggaguuuagcucuuguugcccaggcggagugcaauggugugaucucagcucacugcagccucugccuccuggguucaagcgauucuccugccucagccuccugaguagcugggauuacaggcaugugccaccacacugggcuaauuuuguauuuuuaguagagaagggguuucuccauguuggucaggcuggucucgaacuccugaccucaggugauccacccaccucagccucccaaagugcugggauuacaggcaugagccacugugccgggccgaggccaggaguuucagaccagccugggcaacagagcaagacccuuuaucuugaaaagaaaaaaucauagacuuuuucagaugugugacauuugaagaaguaaaauacaguggaauaacuauaggcuucagucacagauuggauuuguuaucucuuugccuugguuuccucaaccgaaaaaggaaggaaauacuuauaauuuguuuugagguuauuuuauaugaaauguaugugaauguauuuagcauguaauugcuuacuggacagaucaguuaggaauuguaguuggcugguaguaacaguucuggaauaauguaguugugaugguaaguuagggaggcagauaagggcgggcuucaugucaucagggaauccagauugccgcaguguguauucccagcccucuucagugcauuacuuaaucuuaaaggcaucgcuucugccaucacgucacuguuucaugcagugggaggaagaaaggggugaauaggcagaaggcuaagagcuagcugagacuauuccccuccuccaaugaccaaaggaacuuuucugagugucccucccuacacauugcccugaucauccugagcuagaagugucucguugcaagaaaggcugggaaacaaggcucuuugacugcccugaauacaaucgggguuuugauaguaagaaggagagaauggauacuggguuggaucacguacagugucuuucacagugaauguuguuucgcuuuuuucuuucauuuacauauuugggagcauuauuguauaggccuagcucccaugaacugucccacauuguggauuuuauuuuuuucuuguuuuuuuuccaccuggagaacaccgugaauuuuuguuuaugaauaucuuuuuuuuuucgagacugagucuugcucuguugcccagucuggagugcaguggcguaaucuuggcucacugcaaccucugccuccuggauucaagcaauucucuucgucagccucccgaguagcugggauuacaggagcucgccacuacgcccagcuaauuuuuguauuuuuaguagagacgggguuucuccaucuuggccaggcuggucuugaacuccugaccucgugauccacccaccuuggccucccaaagugcugggauuauaggcgugaaccaccgugccuggccauuugugaauaucuuaugucuuucggguucugcuuugcugggggacugggcuuaugugauaaaauuacuuaccuugagcauuaaaggaaaacaaaaaguuaaacuuuuuuuuuuuuauucauaguuuagcuuguacccucaaccuuuaacucagaggaccugauuugggaguucagcggugguugaagguugguagaggagaggcagaguguugggaggaaaggagacugccuggaggaccguccagggcuuucguccuuggcucugugcggcucagagaccuuggggcuuucacuuccuucuuggguuaucuguguccuuaucuaucaaauaaggaguugguuuagaugauuuuaagucucuccaacuugaauauucugauuuuauauguagacauuauacaugcaacucuuauuuucugugugugugugugugugugugugugugugugaauguaaaaggccuucacaaccauauguauaccugguauugccuucuagggaauacagaauugaagauagaguuaugacauaaaaucucauuuugaaucuuauucucuuugcagagaaauaugcacaguaaaacuagauaaauucugcaauuuauuaccuucuugguaugaauuuuuacuagggcuuuuuuagaaguucaaaguagaaaaccuuuuaacaccuucauuuggaauuuuaaaauguggcagugaaauauuucacauucagaaaccuguguuaauguuaacuaggaaaagucucagucuuacgccauuaguaaugauguguuguuauccuuucauuucuagaaauggaucccuggaauuagauggaguauugugaaaguauaauuuuaaacaaauguuuuuguagagacagggucucacuauauugcccaggcugaucucuaacucccaggcucaagugauccuauuacuuuggccuccugaagugcuaggauugcaagugugaaccaccaugcccauccugaagguauaauuauuaaaaugcuauccaguguucauaaucugcuuaucuaauaauucaaaugcuuuguuugcccugcugaggucagacuuuggccuacucugugaaugaaucaguuuuugcuguuguuacggaugguagaguugagucaagauguuaauggcccuuguccaauauggggagcuaguuaagaaugucuucugauucuauccuguggagugagaguaucuauuuguucacuugauggaaacuuacaguucccucgugucuuguuucaguuuuguuuuucauguggaauacaucuagagagacaguauggcuuaguggaugggacaggcccuugugagaauuauuucaaauaauuuuguaauuucaacccaguaaauuucuccaucacuguuccugaucccuggcauuaugaacaauagguuucagaaagcuuccauguuuuagaaccucuccuaccugagauuacaggugugagccaccacaucuggccaagguguuauagauucuuuaaccuaaauuuggcuuauuacuuggaaauguuauugaggaaauugguuaucaguuuuaugauuuucuaaauuacuauauaacuucuagucacauaaaaagugucuaagcuuguccauagcaagagagggcugcuucaaauuaugauuaaugauauugcagaacaaacucuggguugguaguaauauuuauugguuaaaauauaguaguaggccuuuaacauggauaugacuguagaucuuuauuuuagcugccacauaguugugaauaaaaccaaacuuacgaaaagcagguaaaacuuuauuuuauuuuggaaguuaguugauaaggguaauucagauugaauugcauaauaauggcaauauuaaguuucuuguuuaacaguuauggacuggaaauuuuucuuucagcacuugggaggccgaggcggguggaucacgaggucaggagauugagaacauccuggcuaacacgguggaacccugucucuacuaaaaauacaaaaaauuagcugggcuugguggcgggugccuguaaucccagcuacucugaggcugaggcaggagaauagcaugaaccugggaggcggagcuugcagugagccgagaucaugccacugcacuccaaccugggcgacagagcgagacuccuucucaaaaaaaagaaaaaaaagaaaaaucucagauacaagccaggcacugugugugcacuuguagucccagcuacuugggaggcugaggcuggaggaucguuuaagcccaggaguucaagucagucugggcaauauagcaagauccccaucucuaaaacaaaauaacucagauacauauaauuagaauaguauaaauaaauaucuguauaccacccuacuauguagacucaauauuuugcuauauuugcuaucucauauuuuuggcugagccauuuauaauuugcaaauacugugagacuucaguguaaauacuuuaacaugcaucuucaaagaauaaggacuguuuuucugggcacaguggcucaugccuguaaccucaggauuuugagaagccgaggcggguggaucacuugaggucaggaguucgagaccagcauggccaaaauguugaaaucccaucucuacaaaaauuagccaggcgugauggcgucugccuguaaucccagcuacucagaagguugaggcaggagaaucacuugagcccaagaggcagagguuacagugagccgagaucaugccauugcauuccagccugggugccagagcaagacuccaucucaaaauaaaaauuaaaaggccaggcacgguggcucaugccuguaauccuagcacucugggaggcugagguggguggaucaccugaggucaggaguucaagaccagccuggccaacauggcagaaacccaucucuacuaaaaauacaaaaauuagccaggcgugguggcuggugcacaccuguagucucagcuacucaggaggcugaggcaggagaauugcuccaacccaggaggcagagguugcagugagccgagaucgugccacugcacuccagccugggugacaaagugagacugucuaaaaaaaaaaaauuaaaaaagaauaaggacuuuucuuacauaaacacaguaccauuaucacaccagaggauauuaauaguaacuucaauuauaucauguaauauccauagaggaaauauugaaauggugagauguuuugucuagccacuuucaaagaaagaaagccuguauuuuuacauuuuaaacaacaguaauuagacaaaguuagcgccaaaaagauugguuugaaacccaugcaauguuagugggaaaaauguucucauucauucuaauaauuuaugaagucagcuuuuuuuuuuuuuuuuuuuuugugacagagucucuuguugcccaggcuagaugcaguggcgugaucucagcucacuacaaccucugccucccagguucaagugauucuccugccucagccucccaaguagcugggaccacagacgugugccaccaugccuggcuaauuuuuuguauuuuuaguagagacaggguuucacuguguuggccagccuggucuugaacgccugaccucaagucauccgcccgccucggccucccaaagugcugggauuacaggcgugagccaccaugcccggcaaaaucagcuuuuaaauuaggguuuaaauuugcuuuuguagcugcauauuuuaaaaaguuugcuugagcccagcagguugauccugcagugagcuaugauugcaccaaugcacuccagccuaggugacagagugagacccugucucuaaauagaugaguccauuuuucugcccuuagaaaauauagaaugaugaguacaauuggacccucaagaguaaagaucagagacagugacacagucuagcagaaaauaaugguaccugcugcaaagggucauuguuaccaaguaagugaaauuguguaguagugguuagcacaguaucuaacacauaagcacaccaauguuagcuuuaaaaaaaaaaaucacguguaauauauauugauuuggaacuauaaacaccaggacuuuuuuuuuuuagaggcagagagucuugauagguuguccagguuguucucaaacuccuggccucaagugauccucccacuuugaccaccuaaacagugagccacugugcccggccaacaccaggacauuuuaaagauugcuuuuuuuuuuuuuuuuuuuuuugacuuuuucuagucauuuguuuauuacauuguuuucaaugacaaaauauuuuaagcaccacaacaaauauguggaauaaaauaaugaacagcauccauuucccaguugucagauuuuaacauugucuucagaacuuuuuuuugagguaauaacaccugaaguuacacuaaagccuccugugaugucuuuccugauuccgcuucccucccugucuucuugaauugucaucauaccauucauguuuauuuucucauauauguauguauguaguauuuuguauguuuauauaaauauacauuuugauucaauauuacuuuuaagauuuauugauauuauuagaaguauucuaguagcuuuacuucauuuguuuccaguucauuuauauugaguuauauguguaccauauuuuuuccauuuuguuaaugcacauuuagguuauuuccaguuuuucaccguuauauacagugucauaauuaacauuuaugagugucuuuuugagcacauauguguuuuucugggauaguguuuuucaagccuuuuuuguucacuagacacaguaagaaauguauuuuacauugauacccaaaauauguguguguuuauuugcauaauguucauauauauaugcauaaauauuuacauguaauagaaauuauaguuuuauaaaauauuuacccugaaaaaauauuuacgcauacaaugugagagaugcauacuugagauaugaauaaauaucccuucauuuaaaaauaagcugaucaggacaauauuugacaaauaauagucuaauguauguaaccugaagcagaauugcugcuuugacagugcucauuuucagcuuggcgagagaugaaaaauaucacucuucaaaguaauuuuaccaaacucacauucccaucagcaacauaugagaguuccuguuuauucauauccacaccaucauuuauccagcuuucuaacauuuugccuaucugauggaugugaaaugguaucccaguguuuucucaguuuauuuucuagucaaauauuuuuggugccuucuuucugucagacccugugcaaagcaguaaagaugguaacaagagaggugagacauggcuuuccuauucuagggagcuugcauucuaggagagagaugaacuuugucucccagugaguggcaaagggacacacaacggggugcaaugugcagccugccuagggaaauggggcuguuccaagagaugaaguuugaccuuggucuugaaagaugagugggcauuuucagagagcuguggaguugaggggcauuccggguggaggggaggcaaaggcauagagcuguaaaaccacauuauucaagaaacuuaaugaguguucaugacuguagagucccaggauuggugaggccaaggaauaagcagaggagagccugcagauauggaggcagguggaguuguaugcugccggcaccagacucauugaagguuuuaaguaggguguuaacaggaguuuuauuuuguuuuuacaagucuaggaauggauucugguauuaaacgugauggucaaucaaguuuuugucuuaauuucaguuucaaacgcauuagcuuagcuguuuacuauagucuuuuugaaacagguagauaauagaaauuauuauauuuccuuugaacuagaguuggucauuuucuauucuuuccuagcauaugacacauuuccuuucauccaugugccuuguuuuuuggugcuuuuuuuuuuuuuuuuuuuuuacuuuguuuuuguuuuugagacaaggucuugcucaguuacccaggcuugagugcagugacacaaucauagcucacugcagccucgaccucucgggcucaagugauccuucuaccucagccaccucaguagcugguacuauaggcguauacuaccacaccuggcuaaauuuuguauuuuuuuguagagaugggguuucaccauguugcccaggcugauuucaaacucccgggcucaagugaucuaccugccucaaccucccaaagugcugggaucacaggcaagaaccacagugcacagccuucuuucuuuucuuucuuacauguuaaacauauacauagagaaagggucuacauuguauaggcugguugugagcuccuggccucaagcauccagcccaugcuccuuaguuuucagugggacaacaaauggucuucacagguguuuuuuauugucaaauaugaauagguauagcuuuguacagguugguaauuuuaagaauuuggauuuuggggccgggcacuugagccugaccaacauggcaaaacccugucucuauuuuaauaaaaauacaaaaauuagcugggugugguggcacaugccuguaaucccagcuacucaggagguugagcaugagaaucauuugaacccaggaggcagagguugcagugagucuugauuguguugcugcacuccauccugggugacagagcaagacugucucaaaaaaaaaaaaaaaagaauuuggauuuuuuggacaaugucuuucaugaggauacuuucagucuuuaucucuuacucuugcuacauuguauguagcaaguauggauauaguuaaaagaacuuccuuuagaaagcuggagugccuccuguuaaucaacuguaugugcgugcauguauauauaaaggugaugauaugagagauugcuuuggacuucuugcagcuuuuggcauuccugggcugccagucccuuuuuaauaggagcauuugucuugcuuuaagacaugaaaguuugaggccugccagugucuaauaaaagcaguuuuuggagagcaaauuacagagagucguguuuugaaauucucagugccuuaaaagaauagaugugaaccauagcauggaauaguaagcacuuauucgcgugugcauacuugauacuagcuuuuggugagaagucucacacuugugcuaguguuaaggagcguauucaaagguauguugguauguucauugagaugcaggggcaacacugagcauuguguagauccuauuuuuaauuuaggagaauccuaugcagguagguuaacuuuuuuaaaccuuacaguucaaaguuguuguuuuuuuaccccuccuuuucaccucccaguucaaaguuuuaauuguguuuccuagcuccuugauauuuaacaauuacauacuucccugcucucucuaaaauaaaggcuuuuuauuaguucaggauuuaguccagggagaccuuuuacugcgugaaccaugcuugagaugaaaagaacuagacagaagcauguauugcccagugucccugccugugcccuuucuucucagaaaacccuggcuaguugauugucucagccucauggucuuuuguuaccaccaaccucccugcaccccagacuccagcaggcacacacacaucugcacacacacaguuuagcugauggagaaggaguagggaugugaggguguguccucaggguaggggcugggacuauuucauuuucuuucugucuucagcaaauguaaugcauguuaacaccuuggcaguaaaagugggcuggaucaguuggauacaaggugacuguucuaaaauaaaaugaaaaacagcauaaucucgaauuuguaggcaacaugugagacccagcaaauggaacuuuuuguuuguuuguuugagacggagucucgcuuuguugccaggccggagugcaguggcacgaucucggcucacugcaacuuccaccucccagguucaagcaauucuccugccaguagcugggacuacaggcaccugccaccaugcccagcuguguuuuuuuuuuuuuuuuuggagacggaaucuugcugugucgcccaggcugaagugcaguggugugaucucggcucacugcaagcuccgccucccagguucacgccauucuccugccucagccuccagaguagcugggacuacaggcgcccgccaccacuccuggcuaauuuuuuguauuuuugguagagaugggguuucaccguguuagccaggauggucuugaucucuuaaccucuugaucccccuucuuggccucccaaagugcuggaauuacaggugugagccaccgcucccagccgcaaauggaacuuuugcaggugguuuggccauuagccguguacaugcuuagaguguguuuaggcuaguggacaggauguucucuguguguacuguguaaccuugaggcuuugcgucuauuucuauuucccuagaaaugaaaucuaaaacaggcugcuuuccuucccccuagcuuuccaaacaaaaguaaggcuuguagaugugaacuagacuguugcaaaguucuggagaggauggcugugguuugggauuugauuuuugguaggcuuuuuuuuuuuuuuuuaauuguuagaacuugagugugauaaauggcuucuuuuuuuuuuuuuaagugggaagaaaauacaagaucauuaaccacuugugcauauucuauuucaaauggcuuagaaauuuaaagcaaacuuguuaaaguuuguagaagcugaguuguugauuucugugguggauaaaagccagugcuguaucuggaaacuguuuuccuguuuuucuuagauaccccuugaaucggaucuguuuaauggaagaggauuuuucuguuaagcugguuauaaugccgguuaaacuuuguguuuaggauguuaaaguccuggaaugaauauaauuaccugccuauauaaaaaaagcugaagucauuugacgaaaaguuaacaagugcaggcaugugagcuauuugaaaauuuaaaaugcaucugagagagcuuucuaagauucagaggguuuuauggauuuuuucuggcuuuuuaauaauugaacuuuauaugaaauguacauuuuagcuagauggacuuacgaggcagauagaggucaaggaauuuuuaaauuauagauugucuuugcauugccuuuggucuguuucuguauucugaacugaugauugaaagaacgaucugugguacucaacauuuuuauggauuuugagauacaaagggagcucaaaagcaacugcaugcuggggaugguaggaguucucuugaaagacaggcagaguuaggagggucugggccacuuagcccguuugcuuuugcuuuggccacagguacgggcaggcuguuuuacaaggaguuaaaguucugcuucuaaacagaugccuuucuguuucaguguuucuuccuagugcucugaaaaccauauguggggaaaauaguucguucuguuuagagguuaaggguguugccugccugaaaguaccaguaguaguauuuaguauuuauuuauuuuuuugagacagagucucgcucugucacccaggcuggagugcaguggcgcaaucucggcucacugcaaacuccgccucccagguucaugccauucuccugccucagccucccaaguagcugggacuacaggugcccgccaccacacccggcuaauuuuuuguauuuuuaguggacgggguuccacuguguuagccaggauggucucgaucuccugaccucgugaucugcccgucucaaccucucaaagugcugggauuacaggugugagacaccgcgcccggcuguauuuaguauuuaaauaaagugugaagaagcaggugaagaaaccuuccuaccauuuaacaagagggagccaagcccgugguuuuuguugcaggaaaugugcuucugccacuccuuuaaagcugugaaaguuaauuucacagccucggggaaagacauuguuuccccuaaagaucaggucuugaaguuggaaguugucauuuggucuauaacuuacacuaaugaaaagccucuuagagugcuuacugugugccagacacauuaaucauaguaguaacagcugacauuugagcgcauccugggccggacauuguguuuuuuagcacuuuaaauaucuuccucaguccucagaauaacucaagagguagguacuguuuucuuuuuuucuguuuuaaagaugaaaccuuaggccccuaucucaugccaaguaaguugcagagcugagagauaagcucagucuguauaacucgggagcuuugacucugaacaacuaaauucucuauuaugguacugauaauucccuggacugucuggcagagagugugguucuuuauuucaucaagggagugggcucagagaagauaaguaauuuacugucauaagccuuguguugaaaccagaacucaaaccugggucgguuugaagugaaagcuuauguucuugccacugaguguaucauaugaccucuuagaguacauuacuguaauaucugauuuacaaaggucuuuuuauuucuugugucggcuucccucuguuucuggaggggaguuguuuaaaagguugauuuuuggucgggcaugguggcucacgccuguaaucccagcacuucgggaggccaaggugugugggucacuugaggucaggaguuugagaccacccuggccaacauggcaaaaccccaucucuacuaaaauacaaaaguuagccaggcaugguggggcgcuccuguagucccagcuacugaggaggcugaggcaggagaaucgcuugaaccugggaggcggagguugcagugagccaaaauugcaccucugcacuccagccugggcaacagagcaagacucugucucaaaaaaaaaaaaaauugauuuuugagguggcuguugggaacuugauacguugucugcuggcagcuauguugcaccugguugugguucugaggcugucuggccagagcccauugguacagucaauacauguuaccuucuuaagcugcugacaccaaucuggcuuccaagauaugcauugaguuccaaguggggaagacaagcagauauguguuuccuaguguccagauuccauuuguucuuuuauaaguguuaucuccuuccaugucgguaacaaaaguauggggucguaguuaaguacagagccucugaggucagacuugguucugucacccgcucccuacuagaugacuugaggcaaggcucuuaaccauuuucuccccuugagagacagggucuggcucuugcucaggcuggaguacaguggcguaaucauagcucacugcagccuccaauuccugggcucaagcaauccuugugccucagccucuggaguaacugggacuacagaugcaugccacugcacccaguuaaaggcucuuuacccuucugaggcucaguuuccucaucuguaaaauggauggauguccucaugaguuauugaggggcucgaaugaaacauacaggccuuagaugcuuggaauggcaucuagacauggcggguguucagaaaaugauggcaguggugguggagauagcaauaacuucucugcuguguggcucuucucuucuauuacaaaagaucaggaccuuuuguaacaggucaaggugaaugcuuucuggaguagacuguuguguuaaugcucugaauuggauauaaaguaaaauuugggauucccuuuauuuuguaggcacauguaagucaauaaauugccuuguaauuuaaauccuauauagucaaauucugugcuguacucuuuuuuuuuuuuuuuuuuugagacggaguuucgcucuugcugcccaggcuggagugcaguggcaugaucucggcucacugcagccucugccuccgggguucaagccauucuccugccucagccucccgaguagcugggauuacaggcacccgccaccgugcccagcuaauuuuuuguauuuuuaguagagacgagguuucacuauguuggccaggcuggucucgaacuccugaccucaggcgacccacccgccuuggccuccgaaagugcugggauuacaggcgugaccaccgcaccuggcccaauguuguacauuuuuauauucuuugaaaccuugacuuuuauuggaaauguacuugguuguguugaacaaaauauuugaggaaaauuuuuagugauuaauuauuaaaaaugagccuuuuaaguucuuguugaacuugaacauaguguacauuucauuucucaaauggaaaaacugagguaggaaauagggauaggcuuugccuaaaggccguugaguaaaguaugagugagcgggcuuuauaagggccaaaaacagguugugcaucccuuaucugaaaauccaaaaucuaaaaugcuccaaaauucaaaacuuuuugagcaccuacguaacacaaguggaaaauuccacacauaaauacuuaacacaaacuuuguuucauguacagaauuauuuaaaauauuguuuaaaauuaccuucagacuauguguauaagauguauaugaaacauaaaugagcccagugugguggcucaugauguaaucccagcacuuugggaggcugaggugggaggaucgccaagcccaggaguuugagaccagccuggacagcauuaugagaccccaucucuuuaaaaagaaagaaauguaaaugaauuucauguuuagacuugagucucaucgccaagauaugucauuauguauaugcaaauaaauccaaaacauuucuggucccaugcauuucagauaaagaauacucagccuguaguaaauauuuuaggcuuugugggcuguauggucuuuuuugcaacuauucaacucugcuguugcagcacagaagcagccaucaauaauacguaaauggaugggcauggcguguuccaguaaaacuuuauuuacaaaaacagggggugggcccuaguucguggaccccuaaacugaaggaacauuuuaaauucuaucucauaauaaaggccuaccuugguccugcaucucucuguguacauguauuaaagguuguuuuucccuuaggcuucauucucagucaucuuuucacauaacacauccuuugcuauaaaaugauucauagacccgguaugguggcucaugucuguaaucccagcacuuugggaagccgaggcagaaggacugcuugaggccaggaguuugagauuagccugggcaacauaucaagacaucgucccuacaaagaaaaauuuaagaauuagccaggcaugguggcacacaccuguagucccauagcuacucgggaggcugaggcaggaggaucacuugaacccaggaguucaagguuacagugagcuaugaugaugccacugccuuccagccugggcaacagagugagacccugucucuaaaaaauaauuaaaaaaaacauauaugugcauuuuuaguugaguuguuguuuccuaaacucuagguuaguguaggugccugccuuccaaauaucucuccaagacgaucccaacaggccccuaaaaccuugcauguccaauacugaugucaguacuauuucuuccaaacucuuacuacaaucuguuuuuuuguuuacuuaccuauugccgaagugggaaaccugugugucuuaacaaccucccucauccuguuuguucuguccucauuuuuuuuuuuuuuuaauugagacggagucucacucugucacccaggcuggaguggugcaauggugugaucucagcucacuggaaccuccaccucccagguucaagcaauucuccugccucagccuccugaguagcugggacuacaggugugugccaccaugccuggcuaacuuuuuuuuuguauuuuuaguagagacaggguuccaccguguuagccaggauggucucauuuuccugacccugugaucugcgcgccuuggccucccaaagugcugggauuacaggcaugagucaccaugccugaccuguucugccucuuuauucucucccccaacccugcccuccauugcgaccaccacuguuugauucagggccucgggaccuuaccuggacuguuggagauaaucucacaacuucagggcucccugcaucuagucugucuccuuccagucugccuuucaucuuggcugccagagugauccuguuuuguuuuuguuuuuguuuuuugagauggaaucuuacucugucacccaggcuggaguacgguggugugcucucugcucacugcaaccuccgcuucccggguucaagugauucuccugccucagccuuccgaguagcugggauuauaggugcccaccaccacaccuggcuaauuuuuguauuuuuaguagagacgggguuucaccguguuguccaggcuggucuugaacuccagaccucagacaaucagccuuccucggccuuccaaagugcugggauuacaggcaugauacuguuuuuuguacaucugauuaugcuacuucuugccuaaaacuccuuaguugcucuuuagcacccaugguuuaaagccuaaccuugguauaaaaaucgguuugauggagucuugguuuaaaagucaguuugauagagaaguagugccuuccuaccaucggucaaagauacaaugcugugcuguaugccucuccccuccccuagccuucucaagggacacuuccuaacucuucuacagagucccuuucucuuuuggccuuuuuguuuuuguuuuuguuuuuuuuuugagauagagucuugcucuguuguccaggcuggagugcaguggugcaaucuccguucacuguaaccuucaccuccaggguucaagcgacucuccugccucagccucuugaguagcugggauuacaggugccugccaccacacucggcuaauuuuuguauuuuugguagagaugggguuucgccauguuggccagacuggucucgaacucccgaccucaggugauaugccugcuucagccucccaaagugcugggauuauaggcgagccaccgugccuggcaacuuuuguuuauucuucaauauucaccucaagccuugcaucuuacucaaagccuuccuugaaucacccccccucuauauuuguuuucaacccuuuucgugucuucuguaugcuuuaauugaccccuuuguuuuccccucagaccacuuuauauaaucagcuguuugcuuguggcuccaacucccaccucuuucaagcugcuccuuagaagauagauucugugucuuaucucuuugucccuagauccuagaacuguuuguauugcgucugggcuuaagcauugugaagaaugaguggaaaaugguaaauauuuauuacuaaagagguggggccacauguacauuuauauauuuuuuaauacagacagggucucauuauguugucuaggcaggucuugaacuccuagggucaagugauccucccaccucagccucccaaagugcuaagauuacaggcgugagccaccacucccggcccauuuuucucuuuuugaaggguucuuauuucuacucuuccagggcaauuagaagcaaaaggaaaagacccuuggacuggagucugguagaaagaaugcucagugagcaaaccuggggcucugaaccguccccuuguauguuuuucauggccuugcagcucacuccuuggagcugugguucuuugagguguaggucagaaauucacggggugcuucaucaaagugugcaugucugaugaauaccuacccccugccugccccucucuagguaucaguggggcggggaaugucacucuccuggugauucuuguacauguuucuucuucccauuuccggccauuuuucccaccugacauuuucucccugcuccuuauauuacauaguucuuuaugaucuuucuccuguguuuuguauuccuucucugagagagaggggcuccaguugcaaugagguucaaaugaugguuuuagugucucaauuaaaacucugaaugcacuuacuuuuuuuaguaaaagcauugguauagaugauggcuaauauuccagaguuaaauaguguacuucagauaaaagugaguuaaauuggcuuuuguguguaggaaguuacauucugaguucuacgcaauggacuuaagaacuuuugaaacaaaacuuaaggcuguuaguuaaggacucauggagucagaucugcaguagagaacaucauucuauaccuccugccuuauuccccucuugugaccccccauuucuucccuuuacugguaagaaacccaggagcaggcagucuuuguuggggauaaucauagauuggcccuuggaaaguggauuggaaaauuugaagguggugcucauuuguguuuaaacaauuauuugcuaucauauuuagcaguaugcuuugcugguuuuuagauugaaccuaugcagacaguuagcuggagccucuaaagaagaaacuuuuuauucuuaagugacugacugcuuaguaaucuacauaacaaaugaaccauuuugcuucagagacgugaaauaggcaucuauaaaugaauaguuuuugaaacuaaaguuguuaagacaaaguucaucuuuucacaguaggguuucuccagaaaacccucuuuacucuauugaaaugcagcuaguugaacuaggaaagcauauuccaauaauaggcccaugcaauuagccuuuaguauaauggaaugaaugguggaauuuuuugugcauugucaucaucaguugguguuagucccaaaccacauaauagcuagaaaccuugauugggagacacaaagguuucuuauucaugggcaugcuuuaauucuugaaacuaguaaaauguuagacucuuaaaucuuaacacuuuuuugauaacugucuacugcugguaagauuaagauauggugcuucggaauuaugucauuauuuugagugagaagaaaugucgaggaacucuucauuuagcaccauauccaagccaaaccucguauagaaauuacacaguggugugcuggugaauauugaacaaccacccuggggagggggauaaagcccugauuuguaauguuugcugauuucugagguauaaauacucuaucauggcugguuucaggcuacuaguguuauguugcugaaguugggaaaaaauguguauaaucagcuggcuugaauuaaucucagcuaucaaauauucaggauuuuacagccugacuuuuuuuccagccuguauuuuaauaaucugcuuauucuugucuuuaucuuuguccuuuguuuugaaaaaauuggucuuccugagguauaauuuauaugcaguaaaauucagcaauuuuaaguguauacauuugaugaguuuugacacauguauaccucgucacaaugaugauauuccauuaaccuuucuauacacaguugccagauuaauuuuccuaaaauugugcuuugcauccgucaucuaccucggcauaaaaccuucacuggcuauguacuguucauaggauaaaguacaaaaugcuguggucuggcucucuaccgucuugcuuuuugucuacuuaucugcuuuuaucuaccacaacccggcuacaugaaccucuuauugcaauaaaacugaucaacugguucuaggcacaguugcugcaucugugccuuugcugucagcuguacccugccuaugauauuccuuggacaucauauuccuucuugacugcuuggccuuuccuuaaagucuggcucaagccccauuuucuuacacgauccaggcuuuacugauuacuucugcaucccgacagcugucauaccgcuuguuuuggcacuuaacuaucgcaacuuguauugaaauuccagagguguuuuuuggagucauuugaucuuacccaacaaaguuguaaacuaugaugggguaggaaacguacaacggaguuuuuagcacuuugcucaaaaaaaaacaagaacacccccuaauaaauggcuuuugaugaugauaaaccuuuaagcagcucuuccaacucagugagucgcaaauucaguaacacuacuggggagaauaguacucuguuguaccauugacguagagacugaagguuuggucugucccagagcauagauguguaguaaugucucucaaaacuaguauuagucauuaaagugcacauuggagauuuuaucucugccuugaaaauucauccaaagguaguuagcuucauggacuuuggacuuuuggcacggauuaagcguuuaaaguaggucuccaaagaaacuucuuuguuucucucaaccagcuuuauugcacuuuuugaaguacugguaagaggucaggaggguguaucucauugguuuccuuccugucccaggaagccauguuacgguauucugaaagaacuuuuucuuuuucaguaacuuuacuauaagcaaauuuuuuuuucuuuuuaaaacuugaauuuucucuguaagacauugcauacuuguugaaagcagacauuaaaugauaaccuaacaaauacuuaacuuaauucuagaugccuaucuguuucucaggauaccuuguagguuccucuucucuuaaauacuggcuuuacucagggcugggcgcgugacucacaacuguaaucccagcacuuugggaggcugauguggguggaucacaugaggccaggaguucgagaccagccuggccaacauggugaaacccugccucuacuaaaaauacaaaaauuagccgcaugugguggcacacaccuguaaucccagcuacucaggaggcugaggcacaagaaucgcuugaaccgggagguggagguugcagugagccaagguggcgccacugcacuccagccugggcaacagagcaagacugucucaaaaaaaaaaaaagaaagaaaaaaaaauggcuuuacucgggguuucacaguucauccuuaucucuugguaguuaguacccuauucuugagugauuucaucuauuauugccugaauguguuuuuagaauaaaaauuccauaucucuugagcucuggucuuggauggccaaaugccuacuggacaucuucucuuugcugcuuuucagagaccccagauucaacauguccuaaauggaacaucuguauaagucuuuuuuuuuuggagacagugucucgcucaguggcccaggcuggaguacaguggcacugucauagcucauuguaaccucuaacuccuggcuccugggcucaaaccauccuucugcuuuggccuucugaguagcugggacugcaggcgugagccgcugugccuggccucucuguaagucuuaggcccucucuuauuccucgauugcugaaugguauuaccaucagcaauaccaggauaacucaacuugagauaacucaagccagaaacauuggaaucauccuuggcuugucccucuuccuucucuuucugugucugugagguucaccucaaacauuucuuacaaaaauccuuuuccuccucuguuuugaguucuggccaaccuuauccuuuguugggaaggggacuccccugccuuccaagcaucuaauuuguguacuaagagcagaucuacuuccauggcaucagaugaaccaagcucauaagucugaaagguacaacuggaaaaccagcauauaauuuuaauuguguaccaguguuucuggucucuauagguaaacauagcugggaucccauacuaucauuggaaagaagguuauucgagaaggcauuagaacaaaaacaaugagaugaaucaaauguauaauggucugacacaaucugaugauaccaccaucucaucguagaucuguugugaccagaaaccucaugucuaugaacaaagacuccuuuucuccccuaucuaguugcuucaguggccccugccagucuuucuuuuucauucuucuucugagcuugcaggggugacccuuuuaugagauaccuuaauccuuugcaugucugaauacauugauucuggcuguacuugaaucuugcuauguggaaaaccagauuuucucuuucaaauggcuuguacuccccucagucauuguguguugaucucgaguugaacucugaggggccaucuuacuucauguccuuggaaaaaacuucacuguagcugccauauaagagcaaaaugcuaaucucccauugcauuuagccagcaucaccaccucuugaaaacaccuuuggcuuccccaccuccuggauuaggacaggagcaccuucagugugccucuucagcacugcugaguaacccucauaucacucuuaacugccucuuugguaguuuauugauuguucauuuccccacuaaacuuggagcuuucagagggcagaugcucucuuauuuccagauccuacugucuagcguagugccuggcaccuacucacacuauucauuuaaccaguuucuguugagcauccacugacacguagccgaggcuagucacucagcuacaugucaggaauaaaggcaaauaagguucuugcccucuuggaagucgaauuucguucgaggugagggaggauauaaaaagacaaaauaguacucaugauaaaaccuacaaggaaauagacaauagaaugagguagagaauaauugggauggucuguugggcauguacuucaggugaucggaaaggucucuaaggaagugccauuuagacacaccauaaaggccuggugcaguggcucacacuguuaaucccagcacuuuggaaggccaaggcaagaggaucgcuuaaggccaggaguuugagaccagccucgccaacacagcgagauccccaucucuauuuaaaaaaaaaaaagacacaccuuaaaggauaagaaucagcaagcuaucugucaaaacagggaaaucagggcugggcagaagaaauagccauugcaaaggcccuggggaggaagagagcuuauuguguuugaggaaaugaaagaagaccaguguaucuagaaagguaagagaggaagaauguggcagacugagaccgugucaggcauauugugggcuuggaugagugaaauuagacagcugucgauacagugagugauucacauacuuuagauuuguuuggaacuagcacuguuauaaauugggauucuaaauguuaauuuugcacauucuuuucuggaauguuaauacucaaaaaauaacgauugaaagauaaccuagaacuuauuauuuuuuaagagacagggugucacucuauugccgaggcuggaguacagaugccagcauagcuaccuguagccuugaacuccugggcucaagggauccucccauuucagccuucucaguagcuuggauaacagguguguaacacugugcucagcuaguuuuguuuuguuuuuuaaauaauagagauggcgucuugcuuuguugcguaggcuagucucaaacuccugggcucaagcaguccuccugccuuggcuucccaaagugcugggauuacagacgugagccaccacaugcagccauaguuuuaaaauuuuuguagauauggcgucuugcuguguugcccaggcuggucucaaacuccuggccucaagugguucucccaccugggucuccuaaaguguugggauuacaggcaugagccacuaugccuggccgagaauuucagucuuuaugugaaauauauccuacaauuacagacacucuuaggauguuccuuuucuugucugaauuccuaucccucaggagccuggaauaaagcuauauugagaguuuucugugucuuauugagaauuuucacauagucuuauuaaccgucguugcauucugcugguugaucuauuuuagcacaacuguugaaauaaauacuguucauuuaaugccacauccuuaucugaaaaucaguucaaggauaagcacagcugagucauuuaagcuuauaugaguacaguuuuugaacuuuguggauugugcuuuaaacuaguguuuagauucucuguaggugcaaggcuucuuuccucccuugcucucacacauucugugcccuuggcugcacuagguugcauaugcauuauugagguuaaugggaagccaaaugcagagcagggagccacagugaguagcagcucuacgacucaauagcaguccgaccuuggacgggguugcagcccgacaguguauucauuuuuuauaauggaaacaauacuugcaugauaggguuguugagaggauuaaacgauguaacauauguaagacacuaacaccucuugauagaggcuugguaaauauuuggcaccuguuaauccucaguuuccccguaggguaaauaugcuuauccccacuuuuguaaaugguggggggaggcaaggcuuagagaucauuucacuugccuuaggcuggugcuucucaguuacuggggacucuuguuaaaauggagauuuugauucaguuagucugaaacugggguccaguguguucauuucuaacaagcuccuccaccuuaaauaggaggcuguaggcuacuuccuaggaaaugggggagaugggccucaaacccagguuugcucuacuccaaagccuucccccgucccauggagccucccuuauucucacuugugcaacagguuuuuuguuuguuugagauggagucucgcucugucgcccaggcuggagugcaauggugcaucucggcucacugcaaccuccgccucccagguccaagcgauucuccugccucagccucccaaguagcuaggauugcagcugccugccaccaugcccagcuaauuuuuuuguauuuuuaguagagacgggguuuugccauauuggccaggcuggucuugaacuccugaccucaggugauccauccgccucggccucccaaagugcugagauuacagcugugagccaccgugcccggccauguaaugguuuuguuaagagacuuauauguaguuuaaugauuccuuagauuacuaagaucuaaaguuacauuuuuuuauucauuugcucagccuuuucuuagaacucuuuguaugcugaguucccguuuuaaagaucuacuuugaaagaaguaggacuaagugaaaacggguuaauaacacuuaauguugucuguuggacaauuacuuguugucucaucauguuaaauacuccacauuguucuucucucucccccgcucccccaccaaacuugcuucugcuacuccugccugccuuuuauuuuuguuagaacagugucaucagccgggugcaguggcucacaccuguaauccuagcauuuugggaggcugagguggguggauuacuugaggucaagaguugagaccagccuggccaacauggugaaaccucaucucuacuaaaaauacaaaaaauuagccagacaugguggcgggcaccuguaaucccagcuauucaggaggcugaggcaggagaaucgcuugaacccgggaggcagagguugcagugagcugagaucacacauugcacuccagccuggguaagaagaucucaaaaaaagaaagugucaucaucuacuagauuggaaauaucagauauucuugagucuuucuucucccucauauacaguuagucauccaguucuucaaaaucucguugaaauguggcuuccccuccagccagucuacugccuaucaguacuuaccugucugugcauuagcccccaccgaccucuaucccaccagcaucucccuguggcgcugugcagucucgcuguuggucaccuuccucaucagaacaagccugagugugccacacuccucuccagaagcccuguggucuugauagagagaggcaaauaggguggcucaaagaacagacuugaacuagacugccugggcuccuguccucccuccacaacucaccagccacaaauaaugagaaagguacauuugcuagggaaaacauuuaaauacaaauacucaucuugauguguuuaaacauguugagacaguucugucugaggugaggaacaaauuaaggauagauacauugguuucuuauuaauuuaguguuuaagacagugcuuauuuccuuggggaaaaauacuguaaagaaaaagaaaacaccugguacggugagucacgccuguuaaucccagcacuuugggaggccaaggcgaguggaucaugaggucaggagauggagaccauccuggcuaacacggugaaaccccuucucuacuaaaaauacaaaaaauuagccgggcgugguggugggcaccuguagucccagcuacucaggaggcugaggcaggagaauggugugaaccugggagguggagcuugcagugaguggagauggugccacugcacuccagccugggugacagagugagacucugucucaaaaaaaaaaaaaaaaaggaaaaagaaaucuuaaucauacgaugcuauauggcucagaagugaauaauauuuacauguauacguauguaacuaaccugcacaaugugcacauguacccuaaaacuuaaaguauaauaaaaaaaaauuuacauggucauaauauaaucucuaaauagugauuuggccaacaauggugaugugauuguauuccauggagaggaagaagaaacaugggggugagguugaaaauccugauacuccaaugugagaaagucauuugauaauauucgaaacuauaaaaucaaauaguauauacaaauguuauauagauacaaugaauuaucuuccauguguuugaauuaucuucuaugggaucucacauuuaaguagucaaggguaaacucuauggcuuuuagcaaauuggagaguaacauauguguuacauuaauguuggauguugagauaauuaaauccaugucauucuuuugugagaacacauuauuuugcaugcuguaauagcacaguaguuuggaauaaggagcuauuugacguaucagguccaccuaagaaauaagaaguuaacuucauauccuauuuugggcauagauuuauuuuauuauuuuaauuuuuuuuuuuuuuugagaugggucuuacucuguagcccaggcuggagugcagugaugugaucucgggucacugcagucuccacuucccauguucaagcgauucuccugccucagccucucgaguagcugggguuacaguugugugccaccacaccuggcuaguuuuuguauuuuuaguagagagacgggguuuugccauauuggcuaggcuggucucguacuccucaccucaagugaucugccugccucggccucccaaagugcuggauuuacaggugugagccaugguguccagcccugugggggcacagauuuagaaguacaaauacuuuuuaaguguuugagauguagguaaaauacuacuccuuguuguuugauuaagugaugccguaucagacuaaacucuguccuuguuuuuguuuuuuucugaucagguucuggaguuaaccugucucacacguuaggugagauuuaauugauuagccuucucuuugagauaguugaugaaaggugcuucauaucuuaguaaguuuuuguucgugaauccugagcacaugcacguguuguguuaaagaggcaagaaggaacaguagagcgaaucccugugaaaagcaugcuuuuccccaugggucaccuagccagggcucuguuggauuggugaacagcaugagagaaaaaaaagcacuggacaauuugagcugcguuuggcaauugaggugguguuuaaaggugaacuuuauuuuacuauaaaagcuuuaauacugguauuggugagagcaugagggaaacaggucugcuuaggugaugguaguuagaaaguaacuggaugcaaccuuuuugaaggauauuuaagcauuauaugucaaaauuagguauacagcccuuugaauagaaguuccacuucuagaaauugcaaacagauacuugaaaaaguauaccaacagacauguacugggauguuuauuguaacuaauagcaaaacaaaacaaaacaaacagcagacaacagccuuccuauucacuaauggauaugaaauuacggauagguaaauuaugguauauugacauuauacaagcacuaaaaaaaggagcuuagaucuauauguccucaaacauauccucccuagaugcaugggcagagguauuuacagaacaguuuguaccuacaugucuuuguguaugugaugacguggauguguguguauauaaacaucucuauggaaagugcauaagcaaugguaguaucuaggcagugggacuagaaguugcgggguggaaaggcuauuuuaagccccagucauguuuuuaaaagacaagaaaaaaaaaaaaaggccugcaacucaacacuugaucugaugagguuauuugguuguauugagggugcucuugugucuuucaggagggauucuccucugcacugugcccucugauugcaccagcacaucucacaugguggcaccugagccuaucaguucuacuugucuccguggugcaaacacgagagaaggaaacucaauaguuuuuucaccuuuucaaugucaaguuuucuuacuauauauacauccacuguugugucuagguuuguuuucuguuguuuugcuaaauagcuugauuuuuuucauauuauucaguucuucaggaaguacuacuccuugugagaaacuugauuuuuaauuuccuucucauacuucauaacaauacagccuucauucuuauuguugaugcauauuuaaaucuaaacuucuacuuaagugauuagguugguuucuuuuauacuguuuaucacuucauauguccuaauuguaccugacagaucauuucuuaacuguauguuaaucauuucuguuggucuugagcuagcaguuuugcuaauauggcaggguggcuuuuucucugagaucuaucaccuguuaguaguaugaugcugaaaauagcucuaccacucuuguuguaucacauugcacaccuagauacagucuacuuucaccucccuugacuuuccaggguuuucuugcuuauuuacucauauuggugugauuuucuuaugguaggguguuucuuuaacagcaauuuuuuuccauaaaauaauucauuucuuuugcuuauuuucacuauggguuuuuuuaaaaagcagcauuccaguuuuuguugaaaguuuuuuaucccacuucuuucauccuaaauguugauaaagauaauaaauacaggcagcuuauaauagcuauuugaacguauuaucaaauaagguauuuuccuguuaacuacacuucuguauaguuuuuaagcagaauuucaaucaagaagacacuauuuuucuauaucucuuuagauuacuuuuugauuuuuuuaaacacuguuuauacaaguuuuuaucaaacuuccaacagauaauggguacugccucucauaaaucuuccaaagggacaauggaaacugggcccaguugaauaaagccauauucauuuguuuuggaacgcagaguucucugcauguagauugcauuuagcauucugucuaguguauccaucuguaguuuugcuuuuuucagaauaaaaccuugacaguaauuuugaaccuguuacuuuauuucuuuuugcauguauugcuuuaaaaaggccgaagucuaguauucucuuccccuuuuuaaguuuuaugaaaucaagguuaaauugauauuagugccacuuaauauuugacaccugcuaugccuaaugaacuugaaguaguaaagggagcagcaggggucagccauucauauuaugcaagauaacuggagaacgagcagacuaugauuagagcuuuagacuaguggguucuaaccucuuuauaagagcaaauucauuauuuauaugugcauauguguuaccuuuuccuuuuuccucuggauuuauagguauuugaguuucaagaauuuucuugagauuauauuauagaagucauuaagauggggaaucaaucucuagagacauaaacugguaauuauccaguguagggaaggaaaggaagaugaggcauggucugguuuguggaccugggucuucgaguaaguggcuccaugacuuuggggugcgcugaauguaauguaagaggaaggggaugauggcauaucuggcaucucuuccugcacauuuuuuaugauccauuauucacacuuugaucaucuuuaucugcugaauggguaccgcagcuugguauuuauuaauuaucacccaccacucuacagagguaacuauuugucacuaugaagaaugccaaagaaaauauuuccucguaaaauuuaacugcuuacugugaaugauucauaaaugccugauuaaaaggucugugaauagagauuuuugugcacugacuuagcuaaaugcuaucuucauugaguggcauugcagucuauaugucaaguuagaguaaaaacuguauuuaaaauggaaaaacagaaaagggccaggcaaggugacucacaccuauaaucccagcacuuugggagccugagguagaaggaucacucgagaccaguagauugagacuagucugggcaacauaaggagaccucaucuauacaaaaaauaaaaaaugagccggaugugcugaugcaugccuguaauccaagcuacuggggugggugaggugggaggaucauuugaaccugggagggucgaggcugccgugagcugagccgggaucucgccacuggacuccagccugggcaacagagugagacccuguuucaaucaaucaguaaauaaauaaauacaaugaaaauaaaaugaaaaauggaagcaguguucuuaaagauuuuguuuuuuuuuugagacggagucucacucuguuacccaggcuggugugcaguggugugaucucggcucacugcaacgucugccuccuagauucaagcgauucuccugccucagccucuagaguagcugggauuacagaugcccgccaccacguccagcuaauuuuuuguguuuuuuaguagagacgggguuucgccacauuggaggcuggucuugaacuccuaaccucagaugaucuaccugccuugaaucccgaagugcugggauuacaggcaugagccacgacgcccagccaagauuuuucaaagaacacuggaaacuugaauaccaaaggcacuacauagauacuccauaaagucauauuaaauuuagcuuuuuauugagaaguugcuuuguguugagcacuuugagugguauagcaaagacacauaccgcccaaaaggggaaguaggauuuuuucuguuguuuuuuucugagacagagucuugcuuuguugcccaggcuggagugcaguggcgcgaucucaacucacugcaagcuccacgccauucuccugccucagccucccaaguaguugggacuacaggcacccggcuaauuuuuuuguauuuuuaguagagacgggguuucacuguguuagccaggauggucucgaucuccugaccucgugauccacccgccuugaccucccaaagugcugcgauuacaggugugagccaccgugccuggccuaguaggauguuuuuaaauagauauuuuggggagagggaguuggggggaagaaauaaauagauguuuucauuaggauuuugcagagggccaccugauuauuuguaugucuuuguaucauuuacggggaaauuauauguugccuaugacuuggaaguuuucaaggugaguugcuauugucauuuuuaagguugugauuuguuuuccuugucuugccagccuccugugauuagguagguucugccuuuggaaugacaagguucuuccugcauguuuuucucaugugcgcaaugguuucgucuccccuccacccuuagaauuugcaggucuaggucuuccgccugugcuucccuucaugccauagcccccaugugacaggugcuagagacugugugacagccauaacuaaaugccacuugggacuucugcacagcaugucagaugcacagcucauuguuugccuccaggccuacaguuaaccaggaaagauuuuuguugucuaauuauuuuauaauuuccugagagcagaaaaaguggauuuuaauuaaguaccagaugucuuuuaagguccuaccuucuaaaaguuuuccaaaaaguuuuuaaaacaauuuuucuagauuuggaauuucauuguggacuuguuaauaucucugaagugucucaugucuugagaaucuugcaggacuuuauucucugcgguucaguccaaguuugcagauuuuaaacugaaugcuugacuagcugaugguuauuugacagugagugucaaucuuuccauagaaguaggauguacuuugagaaaagaaguuaaaaaaaaaaaaugauggguaugggccgggcgcgguggcucaggccuguaaugccagcacuuugggaggcugaggccaguggaucaccugaggucaggaguuugagaccagccuggccaacauggugaaaccccaucucuacuaaaaauacaaaaaauuagccggguaugguggugugugccuguaaucccagcuacucgggaggcugaggcaggagaaucacuugaacccgggagguggagguugcagugggccaagaucaugccauugcacuccagcuugggcaacaagagcaaaaacuccgucucaaaaaaaaaaaaaaaaaaaagaugggauuagauaugaaacaaaagcacaucauuuauuuauuuagagacaaggucuuguucuguugcucaggcuggagugcaguggcgugacaugguucacugcaaccuugaccuccugggcucaagcgauccucccgaguagcugggacuacaggcgcaugccaccaugcccagcuaauuuuuuuauuuuuuguagagaugguguuucaccauauugcccaagcugguaucagaguucuaagcucaaaagaucugccugcuuucaccuccuaaaauguuggaauuacaggcgugagccacugcaccuggucccauuuauuauuuuauuuuuuugagacagagucucuguugccagacuggagugcaguggcacgaucucagcucaccacaaccucugccucccaggcucaagcaguucuccugccucagccucccaaguagcugggauuauaggugugugccuccaugcccugcucauuuuuguauuuuuaguagagacaggguuuugccaugucaggcuagucuugaacuccugaccucaggugauccaccugccucggccucccaaagugccgggaguacaggugugaacuacugugccaggcccaaaaguaggcuuuugauuaacccuuuaggaguuaagagaguaauauacuauuuagcuaauauacugcuaauuuauauacaugcauuuguacauuauguaaauuuguaauuuucaguugcaaguaagcaaauaugcacuauugccauaaaacagcaaagcagucaaguuuguuuauuaaggagcuauugauauuucaucgauagccuucuagcuucuaaauauuuuaaagugcguaacugaaguuggaauuucucucaaaaucuuauuuuuuguuuugacuauauuuccuugcucucaagaugguaucauuauuuuucccuauuucccuucacuuuucucucucugaaacuguuucugcaguuggaucauuucugacuuugacuaucugacuuuguaaaucugcuuuuaaaaauauuuuguuggggaugggggugugguacuuagauuucuuaucuuucugauaaaccugucuuaaaauguuucuaugagucuuaauuuuucuuugaaaauuuuuuacucuauuauuuggaagucuggaggaauaauacauucagggaaaagccaaguuauagugaugauuuuccuauuuaaguaacauuuacuugguuuuugccuauguuuggcuugugacauagaaacucuaaaugaagcauaacacuagagaagaaaaauuuccucuccuaaggcuagacugauuuagucugcuaggugguaaugaacaugcuugccauuuaaccuuacucguaccaguugacucuguaaaauuuuaaaacuguauguuacucuuuacuccuaagauaaugggucuuuaaauauucaggguaccauaguaaguugccagauauuuuuuugcuucugggcaauacauauuuauuuugaaauggcuauuuuuaaauaagugauacuucccuuauucagaagcuguuugacagcuuuagccaacuaauuuaguuguaaaccugcuaaaaguuacauauuuuauugauuggagagugucuuucuuaggacauauuuacccuuuuuuuuuuaaacauaaaguaaucucaugaacuucaguuaucugauuuuucuagccuacuauagauacauuuuaaaggauaguagcccagugucaucucccaaacauagcuaaagguuaagaacaaagagaaacuaggaaaagaaccucucaaugcaaggacuuuagcauaacaguaugggaaauuuucuacagcaaaaaauaaguauauuccuuauuuguuccuaaggguauccuuguauuuuguaguacaguauagcaacuauuauucauaaugaugacccagcaucaagaaaggguguaguuggcuggaugcggugggucauaccuguaaucccagcacuuugggaggccgagguggguggaucaccugaggucaagaguuugagaccagccuggacaauauggcaaaacccugucucuacuaaaaauacaaaaauuagccgggcgugguggugugcaccuguaaucccagcuacucaggaggcugaggaaggagaaucgcuugaacccaggagguggagguuucagugagccaagauugugcuaccgcacaccagccugugcgaugggagcaagacuccaucucaaaaaaaaaagaaagguugaggccgggugcgguggcucaugccuauaaucccagcauuuugggaggccgaggcgggcggaucacgagaucaggagauugagaccauccuggcuacggugaaaccccgucucuaccaaaaauacaaaaaauuagcuuggccugguggcgggcgccuguagucccagcugcuugggaggcugaggcaggaggauggcgugaaccugggaggcggagcuugcagugagcccagaucacaccccuacacuccagucugggcaacaaagcaagacuccgucucaaaaaaaaaaaaaaaaagguguagcauguuuuuuuaguauucugcuuaagaauguaggaaaaaaacuaacacacacacacacuacauuuauaaacuuugaauuuuaguuuuguggcaauucauuuagguaaaguguguguguguuuuuuuuuuuuuuuuuguuuuuguuuuuggagacaaucucgcucuguaacccaggcugaguacaauggcaugaucucggcucacugcaaucucugccucccuguucaagcaguucuacuguguuagccucccaaguagcugggauuacaggcacgugccaccaugcccagcuaauguuugcauuuuuacuagaggugggguuucaccauguuggccaggcuggucuugaacuccugaccucaugauccgcccaccuuggccucccaaagugcugggauuauaggcgugagcuaccaugcccggccuauuuauuuuuacauuaaaaaaauuaaguuccuguugugucagcugcugggccugguaccuuuggauauacaguauuucauuuaauuuuccacaauucugugagugagguaaugucccuucccugcauccccucccccuuuguuuagagauuaagaaacaggcucagauuuagccaggugcgguggcgcaugccuguaaucccagcuauauaggagguugaggcaggagacucucuugaacuggggaggcagagguugcggugagccaagauggcaccauugcacuccagccugggcaacaagagugaaacuccgucucaaaaaaaaauaaaaaauuaaaaaagaggcucagauuuaauugauuuauaaguugacuauuuuuuuuuuugagagagucuugcucugucacccaggcuggagggcaguggcacaaucucggcucaccgcaaccuccaccucccggguucaagccauucuccugccucagccucccaaguagcugggauuacaagcgcccgccaccacgcccagcuaauuuguuuuguauuuuuaguagagacgggguuucacuauuuuggccaggcuggucucaaacuccugaccuugugauccacccgccuuggccucccaaagugcugggauuacaggcgugagccaccaugcccagccuauaaguugacuucuuuaagucaugaguuuuccagcuguuuauaauauauugccacuugguuuauccacugauaaccucaaauuuaguguuuucaaaaguaaacuuacuaauagugucuuucauuacaaaacugauuccugcuguccuguguuucacuuugccauuaauaguaucaccguuggcugggcgcaguggcucacgccuguaguauuuugggaggccaagguaggcggaucaccugaggucaggaguucaaucccagccuggccaacauggugaaauacaaaaaucuaaaaauacaaaaauuagccaugcaugguggcaggcaccuguaaucccggcugcuugggaggcugaggcaggagaaucgcuucaaccugggaggcggagguuguagggagccgagaccacaccauugcauucuagccugggcaacaagagcaaaacuccaucuuuaaaaaaaauauauauauaaguguguguauauauauguguauauauacauacauauauauacacacguauauauacauacauauauacacguauguauacauauacacguguauauauauacguguguauauauacguguguauguauacguguguauauauauaugugguaucacuuuaccugucugagaggcuaaaauuaaggucucagacuggcaacuucauucauguguucaucuuauuuuuaaauuuauuuguuuuuaagcuacagggucuauguuugucacccaggcuggaguucaguagugucaucauagcuuacuacagacucaaacuccugggcuccagcaauccucuugccucagccgucaaaguagcugggacuacaggcucguaccacccugcccagcuaauuuuuugguguuuuuuguagugaugggggucucacuauguugcccaugcuggucucuaacuuaacuccugggcucaugugauccuccccugucagccuuccgauuagcuaggaguauaagcacguaccaccauaccuggcuaauguuuaaaaauuuuguuuuuguggagacuggguuuuguuauguugcccaggcuggucucggacuccuggccucaagcaaucuuucugcccuugcuucccaaaguguugggauuaaauagguaugaaccacuacacccggccucauguucauuuguagucuacuguuugcuggguacucuucugugaacaaaauaaacaauuccugcucuuacggagcuugcacugcaguaggagauaaaaguaaaauacauaguauauugcauggugggaauguuaggaguaagugguuguaaauaggauaucccagaaggccucacugagagggagacauuggagcacauauacuuuguuuacacuuagaaauuuagagcuugaauuagaaauuagaagauugauuuggagaucugcuuuuuuguuuugucaugaaaauuagacauuguagcaacguuggagcuuucuacuggcucugccaggucuguucagcugugaaggccugugagggcucuguuuaaugucccaugauucauguggcuguuaucuuaguugaggucuugaauauuucuuuccuacucuuuugcuuuaacucugcuuauucccaccuucagccaguccuacacaccacaguuggguuaucuuuguaaagcacagguagaugcacugugcauggaauacuguuucccuguuugccagauaaaauccacacuucggagcccuccguaaucuggucuuggccuacuuucuaguauucccuaggguccacucaucaaaauaaaaauguauuguucucaguuuccugaaucaguucuauacuaaaucuuugcauuaaauuccuucucccaccucgacauguccaaaucacacucuguuuaggacauuuuguaaguccuuaccuuccauagcagaccaucccuaucccucccuccgggcuggaagaaaucucuccuacucuaagcuauaguauuacuuuaugcaaacucuuucuguacuucuuaaugaacagaucucguguucccuugcuagacuucaaacuucuggaaggcagucucuguguaagaguaguuuuuguggcugggcgugguggcucaugccuauaacccuagcacuuugggaggcugaggcgaacggaucacuugaggucaggaguucaagaccagccuggccaauauggugaaacuccgucucuacugaaaauacaaaaauuagccagguguggugccaggcgccuguaaucccagcuacucgggaggccgaggcaggagaauggcuugaaccugggaggcggagauugcagugagcugagaucaggccacugcacuccagccuuggcgacagagugagacuccgucucaaaaaaaaaaaagggucuugcuauguugcccaggcuggucucaaacuccugggcucaaaacaauccucccaccucagccuccugaagugcuaggauaacaguugugagccacugcaauggucccuaaaucuuuauacauauggauuucaucacugauagcagcccacuucccauugucuuuucucaaugccacuuuucuuuuuuucuuuacuuagcaaaccuuucccaagauaaugcucauuuucugaauagcuuuuauuucugccauucaauuucucuuuugaauaaaaggcuucccccucuucauuugaagaacauuaaaaacccuuaaaaauuuuuucagcuucuuauuucaaucaggagccuuucuguuggacaugaccauuuuuccuuguaguuuaagagcuuugguuagcauguugccuagaggcuguuugucauggauauacagacacaugcuugucuuccuuccaugugauuguauuuuucauagacauccuuaugaaaccacuugaacuuguuuccuucagaauguuagcagaguaugcuucucuuucaauguaaagucuuugguuuuuuuguuuuugcuuuuguuuuguuuuguuuuuugagacggaguuucauucuuguugcccaggcuggagugcaauggugugaucucagcucaccguaacuuuggcucaccguaaucuccgccucccgaguagcugggauuacaggcaugugccacaacgccuggcuaauuucguauuuuuaguagggacgggguuucuccaugcuggucaggcuggucucaaacucccgaccucaggaggugugagccaccucacccagccagucuuugcuuucuuaaauacuggaucacuugcuauuuuuugucuucuucaaacugucgcaccucaggaaaacuuaacauuguuucauaaauguucaagagaggccaggcaugggccucauuaauaguaucaccuuuagcugggcgugguggcucacucccauaaucccaacacuuugggaggcugaggcagguggaucacaaggucaggaauucaagaccagcuugaccaacauggugaaaccccgucucuacuaaaaauacaaaaauuagccgggugugguggugugcaccuguaaucccagcuacucgggagacugaggcaggagaaucgcuugaaccugggaggccgagguuguggugagcugagaucgugcgacugcacuccagccuggguggcagagcaagacuccaucucaaaaaaaaaaaaaaaaaaaaaguucaagagagcucuaguagcuaaauucuaguucuaguucuuguucuuagcucuaguagcuaagcuuuaugccucuacaaagcuaaacuuuugaugauaacuauguuauuagguuuuaaagaacuuuuacuguauuauggaaaacuuaaauguaaaacaaaaauagugagaacaguguaacaaaucaugugccgcugggacucgaucauuaacauaggauucaaucauuaacguugcuggcccucuacuguuucuucuacaccucuucuacccacacuggguuauuuacuagcaaauccuagaaacauuuuuauuaguaaauauuuccauuuaugucucuaaaagagaaggauuccuuguaaacauaucccccccaaagcacuauuuuugugauacuuacauauuaauggauuaacagacauaucuuuuuuuuuuuuuuuuuuuuuuuuuuaccaaaaaacaaaaaaccagguagugaaaauugccaaguuucuucagcuuuccuagugugacucaucuccaggagaguaggaagcaggugggucugaacacagaaauccacacgacuugcuucugcccucugcacagaagcgcguucuuuaugccaggaccucauucccuuccacacagcucagggagggcacucuuuuauuuuaugaacuuguuaucaguaaauuuaggacucaguggucccugaauccuugguccuugaccuguuauugucaguccuuaaggcccagacauugccuuuggcuuccuuucuggaaaauuucagaacuguauaaaaaucacuuguaaaacucugacagacacauuuugccaagaaugucauuuaucucuugacaguuuggcauuugccuuuaaauauuagauuguguaaucauaauggcauuccaggaaaauaaugugguagguggcuggcacuuuaaaaagugaaauggacuuggguucuugggaauguuaaucauuauucuacacaaaauggugauaccccuuaauagugaaaugcuaaguggguauaaagcaguauuugugaauaagaucaaaaaagaugaguauaaaaugugauuuauggguuuauuuaaugaguuuuuaccagaacaaugucugaaggauauuuuauauuuuuaagcugugaaacagagaaaguaaugaggaaucuucuagugagucccaccagucucccagccugaccagcacauccagaaaucgaucauuauuuuugucauuuuaaccugccuucuuagugccuuccuugcccuugacuuugcagcagagaggagaaagaaacucguggucucucccauaaauacacgugguaacagcagugaaguaauuauuauauauuuuguggcaagucauucauucaguggugauggaauggcuuauuuuuaaugcaguguuuuucuuuggacuaaaccuaaauucuuuuuucuaucucauuuagugccuguccauuccaaggcagcauaaaguuagcauagcuucucauuuuacugguuugguaaaaguuuuaaagguuuaguucaguuugcuuuuggguuuucauaugagguagacuaugagaacucuuuaauuuaugaugugauauauaauuaaagacaaucccauuguagcuggcaugugggcuauuacuggggaucaugggaaagagaaggcuuggaggaucuucuuuauaaaauacacguaaguauggacugaauuccaaacaaaccgcaaaauggaaggaaccucguuuuaucgcauccagguaaaggauagaaaagguaucuucaguuuucccagaagcaacauccacaaggacaacucguaauuuuaaaugauuaaaaguaauugcaguagaucagugucauucauagcaaauuaguucugauugauggagaaugcugcaucuguggauuuuuauguuauaaaauuaauuuaagacuucuuuuguuaaacucguuuaaucuucugcacuacuccguucuuucauuauccuugucaguuuuaagggcuggaauaucuuuguacaacuaaauucaguugacuucuucuggauacccaaguugaacagacacauauauuaguggagcucugguuggaaagaggacaccaguacacacuauuaguagccuacugcaugugguuuguguuuuuugccuuuuuuuuuuuuuaagagaaguucucucucucucaggcuggaguggaguggcacaaucauagcucacugcagccucaaacuccuaggcucaaacaaucuuccugccuuaggccuuccaaagugcugggauuauaggcaugagccagugcagccagccaccuauuguauaaauggcuuauaagucauuucaccuggcuaggcaugguggcucacgccuauaaucccagcacucugggaagccgaggugggaggaucacuugagcccaagaguucaagaccagcaugggcaaagagagagacccugucucuacaaaaacuaaaaaaauuagcugggugugguggugccugcuguaggcccagcuagggggaaguagaggugggaggaucacugggagguagagacugcagugagccgugaucaugcuacugcacuguagccugaaugacagagugagacccuaucucaaaaaaaaaaaaaaaaaauaguaauucguugaaccaguuucuuauugauaaauguuuagaccguuuccauuuuuaaacuucaaauauuccaggaaacauauaugcagauuuaucagaaacacuuauuuuuguaaacuuuuuauuaaagaauaacauauauacaaaaaguagagaaauuuuuuuuuuuuuuuuuugagauggagucuugcucugucgcccaggcuggaaugcaguggcacauucuuggcucacugcaagcuccaccucccguguucaugccauucuccugccucagccucccaaguagcugggacuacaggcacccgccaccaugcucggcuaauuuuuuguauuuuuaguagagacgggguuucaccguguuaaccaggauggucucgaucuccugaccucgugauccaccugcaucggccccccaaaguguugggauuacaggugugagccaccgcgccuggccaaaguacagaaauuuuuauuauuuuuuuauuuaguuuuuugagacagagucacacucugucacccaggcuggacugcaguggugcaauuuuggcucacugcaaccucugccuccuggguucaagcguuucuccugcuucagccucccaaguuguugggauuauaggcgcauaccaccaugccuggcuaauuuuuguagagaaauuauuuuuguaguucauugaugaaaucuguaaaacccauacauuauguguaucaauucauucuuuuuucuuuuuuuaaguuauauuuuuuugagacggagucucacucuguugcccaggcuggaguacaguggugcaaucucagcucacugcaacuucugccuuccggauucaagcgauucuccugcuucagccuccugaauagcugggacuacaggcacccgccaccacgcccagcuaauuuuuguguuuuuaguagagauaggguuucgccauguuggccaggcuggucgcaaacuccugaucucaagugauccgccugcccuggcuccccacagugcugggauuacaggcgugagccacugugcccagccuauuuuucuuuuuuaaugcuuuguaauuuucuuuugggugacuauacuacagcuuauucuuuuugccauugaugaacguuuggauugucucuaauuuuuggauguuacaaauaguccugugaacauucuuaaacaucgguuucggugaauguaacuauccauauguauugggcguaucuccgggaguagcgcugacaggcauaggguaugcauaugugcagguuuaguacugccaacaguuuuucaaagugggugaaaccauaucacacucucaccagcagugucuauuuuuaaaaaaauaacuucauauaagugaaauuugaauaaaagaguaaauucauuuuaaguuuuggaauauagugcuggauuuguccucagaaguacuaauucguacuccacugaacacuagauuuuauccagcucuuucguuguuuucauuguuuauagugaagaaauaucuuuuuaaacuucuuuaaugaauuggacuuuuuuauacuucaguuuuacccauuuccguuuucuugacuuggauguucuggcuuuuucuuuguugggguauuuguauuuuuuucuugcugcuuuguaauaacuuauuuuuaaaauccacauuuuugucuuccuaguuuaucauuugucuuuuacacuauggaaguguuuuccaugucuguuuucuuuaagggcuguauuguugauauuuaauuuuauuuuaacuggauuugccuuuuuuuacgugacacaaggaugcuuuuuuuaaaaaaguuuuaaaacauuuuaagcauguuaugcuuuuacuuauuacauuaacguuaacuuuggaauauuuugcaggaugucagagggugacuggucagaguaggcaugcaugugucauuugaccaagcaagaaauaaagccaguuuuccuauguggacaguauugaaucauuuuagugugcauguuucuaagguaguaaguuaucguuuagaaaagaauuagaucaaauuagccuagacugaacuaucuuauuuaaauaucucuuguggauacucagggcucuugagcaaggacuuuaccaaaauuacaccuggccucuugcagucaguucugugucucauuggacacgggcuuggagugccaaauauuuaauuucaaaucuuuaaaaauauuuauucucuaugagauuauuaaaacuuuuuaaauguuucuguuuuguauuaacaguauauaauuugcacugcugauggagaaauaugagaccaaucuauuguguuuuccuuuuuaauguuacagugggauuugagagcuucccaaagccucugucaccuaaaauuccuacugagaaucauuuuuggauuuuaccgcaaagcagauacauagaacagauuuuaaacgaguaguccucucuucuaauaugaauuaauuugguuucuagaauugaaucuuagcaccuuaaaggggcaagaaucucagggguagguaaguuuuagaggaagggagcacagccauguuaccccucugugauuagagcccuggagcauaccaaaccuugaggcaagucugaagaagguggaguuuggggggcagugaaaacagaugcuauggauaagaucugaaaaaauuuuuuuuuguuuuguuggucuuuugcauuuggcaguacugcuuguggcaagguuguaucauuaacuguguugauuauuccauaagccaaggagacaauugugggaacucuccuuaguaaaucccucguuuuaggagcauagcauuuccaguuuaggggaauuuguauuuugcugaacauuugaauuugacuaaagggaauacuggguuuauaugacaggcucauuagggauagauugaggaggagaggguagaaagggagagaaaagcuaaaauuaagcgccuauuuuucauguauauuuuuuauuuuauuuuugagacugagucucacccuaucacccaggcuggagugcagugaugugaucucggcucacugcaaccuccaccucccaacuucaagcaauucuuuugccucggccuccugaguagcugggacuacaggcaugcaucaccaugccuggguaauuuuuguauuuuuuaguagagaugggguuucaccauauaggccacgcuggucucgaacuccugaccucaggugauccacccgccuaggccucucaaacuguugggauuacaggcgugagccgcugcgucuggccaguuuuuuauguauauaggcaaaaugcagucuuacacauuuuacauguuuaaccugucuaauccucacagaaauccuaugaaaugcuguuuucccaauuugcaaagagaaaacaaagacucagggaguaaacugacauuauuuuggcuaggcucaaaaacucaguaaauggcauuccugggauuugaacggccgucucugaauccaaagcucaugcauaucuucuuacaagaguauauauugccuccuccuaaacuaccagaauuauuauguauauuuuaucaaugucaugccaaauuuugguaacacuuuaaguggcauaugccugggguguuauugguaauucugccagauacuguaaagccuguguaauuuccuuuaccguccaccuuagcaucgagaguaaacaugagguuacgauccugggaggacuuaaugaauuuguagugaaguuuuauggaccacaaggaaguaaguacauguguugguauguguucuucuauuacagucuuuuacucuguuucuuaauagaauaucaaagacagaugguagcaugcguaguuucugaaaagcaaguuuaguuggacugcagaaccagugaggaaaucuuucucuuaucacaaucacuuuauauacagucaucccuugauaucuguaggggauugguuccaggaccaccucauaccaaaauccacagaugcucaagucccuuuauaagaugacauagaauuugcauguaaccuacacacauccucccauguccuuuaaaucacaucuagauuacuuguaauagcuaacacaacgcaaauguuauguaaauaguuguuauacuguauuuuauuuauuuauuuauuuauuaagugauggagucucacucugucacccaggcuggagugcaguggcacgauuguggcuuaccguaaccuccacuuccuggguucaagcaauucuucugccucagccuucgaaguagcugggacuauaggugccugccaccacgcccagcucauuucuguauuuuaguagagacaggguuucaccauguuggccaggcuggucucgcacuccugaccucaggugauccacccgccucagccucccaaagugcugggauuacaggcaugagccccaccgcacuuguccuuuuugguauuuuuuuuguguuauuuuuaauuguauuguuauuuauuauuguuuggauuuuuuucucuaauauuuuugaucugugguugguugaauccagggguguggaaccugcagauauagagggcugacuguaguuuucucuuuaucucuaugugacaguacuagacaugaauuguaaauucuggguuuuguuauggauggccacgugaaugguuuccaggaaauguuuuuuguuguuuucuuuuuggccuuggaggggggaugaauaugggguuuauugagauaggagggaaaguaacauggcuauuacuuaccaaauaauugaauaguguuuaguacuuuugaagaaucaaguaaauugcagaaugaaucugcuuauuuuuuaacucuggaucuuuccaagaaaaguaucuuaaucugaacgugguacaccuauugauuguaguaggucccugacucuugaaggaauuaauuuggaagguuuucagaagauuaggggauaauguuuaauuuacacucagauuuauuuucuaauuuggagauguaguucugaugaacauuuuuacuuuuauuucagcaccauaugaaggcggaguauggaaaguuagaguggaccuaccugauaaauacccuuucaaaucuccaucuauagguauguuacuacuugguuuuucuccuuagagaguuuugaaaucuaagggggaaaaaucuuacauuucaggggagguaauuaaugccagaaauggcugucuaauugaauuuuuccuuuuuuggcuuugguuaauuaaucagugacuuuuggggggaacuucuauaguguguuagaagacguuuaaauauacucuuugcauaauuauaaugaccauuacuuuagauuuuugucuuuuggugucagauuaaaccagcuuuaaggccccacuguucuuuaagcuguuagcaggaaaauaauaaacauaucuuaagucuaauuuugaaugccagauugcaagaaugaauguuacauaguauguguuuuaauccuaucauuuucagaaauucucccuagauccuacuuugcuuuuuuguucacuccaacucuggguaccuuacaauuaaaugacccuuugcagucuucccaccuccagucucuuuagcccccuaaacagcagaagaaagaauagaaaccucagugggguuguacaaagagguacuuucuccucaccuucaucuccuuuuaccuuaaugggugauguuauuuaccugucacccccauugaggcacucagugacagaucuaucugauugaagguggacaccuuuaaauauuuggagacuguagaaugguaguaauuuaguuaauuuaagccagcuuuuuuuuuuuuugcuucacuuuauacaugucuaaaauauuauaaaauauugaacaauuuuaaguaagaacaauaaaauuguaauauauugagcauucucugagaaucagacuaagccucauguucagaauugccagaguucaaacauuuugcuacugcugugggcuuuuuuuuuuuuuuuuuuuuuuugagacggagucucacucugucgcccaggcuggagugcaguggcacgaucucgacucacugcaagguccgccuccuggguucacgccauucuucugccucagccucccgaguagcuggcacuacaggugccugccaccacacccggcuaauuuuuuguauuuuuaguagagacgggguuccacuguguuagccaggauggucuugaucuccugaccucgugauccgccagccucggccucccaaagugcuggaauuacaggcgugagccauugcgccuggcugcugugggcugucuuaagaaguaaugcccgauauccuggagucuagaccacuccccacuacacccccacuccuaaccaguugaaucagaaauuucuuucuugcuauaggggccucuaaguuucagcguugugaaugguaaagugggaguggagcugugagguguugagccuuugagacagcccccgagcacaucugacuuagcaccuguauagguguagaaacguauacgccuguacaccuucuccuuuugagagggcuuuucuguuguguugugguucccuguccccaguuuauucaucuucuaacuuuaggguguuucugucuacucagccauuuaaaacucuuauguugguuagugauaggacuuuaaagccuuuauagaaguccaugcaaguucauucagauacauuucauaaauaccuguuuaccuaaaggcuaaaaacuggcaugcuaagucuaguuuuguuaaccccacauuccuagucagaaaggaaacaauagagcuuguugaaacuaagagugaacuuauagaaaugcaauuucauauccuguagaaauguuauuucucagaccuuaauguauuuuuucuagauaauaugauuaucucaucauaacuuucuagguaauaaugucuaaacuuuaggcauugcuuguuuauuaacuaaugacacaaaaagccuccacgcuuucuuaaauuaaugaugcaauaugaaauuugguugggacaaaugacuaagcuaauuuaacuucuucauaauuguuucuuuugccuuucugugugcuuucaggacuugauaaugccuacaaauguguaucaucuucuguuuggaaaguagauuuagcugaaauauuuguacaagcuguucuuguuuccucuagaggaagguugcauaagagaguuucaaucaguugugcggggugacccauuuucaggucaucaacaguguaauuacuguugagaugugcuuuaagcauucagaaagguuguggcucacuuagaaaaggcaaggauuccuuuuugaguuguguagauaguuguaaaauuauacagaagggcgaggagguaagaucaacccaaucucaacauucuuuuuaaaucuugccccuguuguaucuggguagguguaguguucuuccugagccaaauuuugagcuuuuaaacaaucagcugugcaaauuuagaucaaacaucuuuaaugcuuggcucuuggaauuuugcagugucuauguacuuuguucuauuuuguguguuuguguauggauguguauuuuaauuguauaaaugacccauauccauuagagcaauguaagaaaaucuguaagccaaaguaaagaaaaaucaaaaugucucauaaucuuaucccuuaaagggugucauuauuuacauucuggaauaugcucuuuaagacauuucucucugaauauuuaaauauauauauucaauauaaugugauaugcuuaucuuugggacacucuccaaauauaguuuuagagggcugucaguaguuacaugauugcaugagaugucccuuuaaaacaauuugcaucuauaaaugaguggguauucgaaauaguggcauagcuacuuuuuggaaagaaaaggaauauagguagacaccuugggagguuaugaacuuauucuuaugaugccauuauuguuucaaacacuuugagcucuuuuuuuuggaauuuuacuucuguuucaguaucauaagugauggcaaaucuugaugcuuugaagcuggaugugaauuuuugaaauggcuaacagucauuuaagcccaaagaauaagaugaauggaaaaacgaguaauaucaauugggguauaaaaccggcccucuaggcacuuugaaaagaguaaaagauauaaaacuccuuuaaucaacuauaacaucgcugaauauuugcauaauuuuccagagagacugcuuugagaugaaucauauuugaaucuuuuucugauuuacuugaaaauucagacuuucauauuuuucauucagaaacauuaguuccuagagugcuuagcaauacugcuggguguuacuguguaggaguuaggagagugugauuggucaguggacugguuaucaggguagagaaguucuggcccugguucuccuugaccaugagagagauaugcagcugacccauuguuuucucugcuagaaaaugagauacuagaauuaaacagauucugcauguuugauaugaccaguguauuaaaacucgggguaccuggcauccugcuggacaugacgaaggcuacagaagaucuuuacugguuaggagagaagaagaauguaaauaaaauacuacguguacuuaauggcaugguuccauuguuuuuuaggagaggugugagucagcaccucaauuuagaagagagagcguaaggaagacauaaguuucuacaagagagauugucuucacaaaagcuucagaguuguugaggugugcaugaggacuuuagagauacucauucagaaccccaaguaauccccaguucaugaagauuuuguuuuaugcaaagaaauugcugcagagacugccauagcucacacuucucgagguucacaguuuuuagccuuugauacuugugcucagcuguuaagugaaagcuuucaccaaacagacuugcaguuacagugugggugaaauaaagaugaaugaucucauagaagaggguaauacagaguaauuuuuaauaaaaaaaaauaagcagaggauacaaaaugguuuuaugucuaauccaaaagaaugcagauuaaaacgaaaguacaguauaugauuugucaaacuggcagauaaaacaguguuagaaaagguauuaugauacagccagucuaccacuauguauugcuugguaaauauuuuauauccuucaaauaauuuuauuuaaaaaguuaaaaauuaucuaaagaaauauuuagaaaugugcacugucaaaagaauacguaaauuuuaguguuauaauacuuaaaagucagaagcaaccuaaaugacccagucggugauaaaguagcuaagugauagugcaucuuaguggauaaaauguuuuacccauuagucauguuuuaacaccucuuugaagggacacacaggaaaauguuuuuuauauaguacaacucuaauuuuuuccuauacauuucacauuugaaugccaaacuauugauguuauccauagcuguucaguuaaaggagacuaaaaacauacuuuucuguaauuuccaaauagucuacaauguuugcuuuuauuauaaaaguaaauauuuuuaaucauauugcaaauguaugucuuuugacuguccugucuguaucauugucugagucuacacuuugcugucuuuugcucuagaaagccaucaggcuuggccagaauucccugugguagcuugcucaggaccugccuaacccacguguuucccagcagccucccuucuuuuuuccuuuaaauuuuaauuauguguguguauaagugcacacacuguuuuccuuccuuuguuuucugcuuagaguuuagaguuuaguccaucucagauacugucuuuacgcgcaacuuucuucacuucuuucuucccccuuuuucucuucucuugggugguuaccucaaguacuucucaccuuuuucuuuucugccugacucuuccacuucccccuuccguuguugcauuuuucucuucauaugaacugaaaaaugccccucuuuagagcuaauaaucauaauggggauacuuuugauaagccuaagccaagggaaaaaaaauauaaaagucuucuaauaaaagauacagggccgggugugguggcucacgccaguaaucccaacacuuugggaggccgaggcggguggaucaugaccucaggagauugagaccauccuggcuaacacagugaaaccccgucucuacuaaaaauacaaaaaauuagcugggcgugguggcgggcaccuguagucccagcuacucaggaggcugaggcaggagaauggcgugaaccuaggaggcguagccugcagggagccaagaucgugccacugcacuccagccugggcaacagagcgagacucugucucaaaaaaaaaaaaaaaauuauauauauaaaaaaaauuaaauucagggcuuauagccacuaaagaucuugcaacauccagaaguucucuucuggaucuauuauauucuccuucauaucauaucuacuuuacuuaaacacuagcauuccagauaaaauuaagaugucauuuuaucuuacauuuaaaugauuauuggcuacuauuaacagaauuguauccuaauuucagauagaacuauagaauauuuuagaaucuuuuguaaauaacuuuaagagcagccuaggaacccugucaucauuuauacuucuuaaaaauuagaaaacuguguuauaagguacagguaacaaguuuagaaaccaauuugugaaaugcuaccgaucuauaucuacauauuuucagugaggaggacccucuacuaggagcaggcuguaugcauugccucuggguugcaauuugaugauaccaaagcugggaagguaagagaaaugguugagaacaggauucuggagggacugcugaaugguuugcugaauguugguagaauggucagguacaaaaccagcaagcucgugcugccauagaacuugaugugaggccgagcgcaguggcucauccuguaaucccagcauuuuggggaggccgaagugggcacaucacuggagacaagggguuugagaccacccugagcaauauggagaaaccccaucucuaaaaaaaaaaauacaaaaauuagcugggcauggugguguauaccuuuaguuccagcuacucgggaggcugaggugggagaaucacuugagcccaggaggcagagguugcagugugcugagauagcaucacugcacuccagccugggugacagagugaaaccggucucaagaaauuaaaaaaaaaaaaaaaaaaaagaauuugauguuaguggcaugaagcaagaacuugccaaacccauuugaguaaauggagacaaaaugaaaaagucaugggcaauacaauaguuaaaauacucugagcuggcugggcgugguggcucaugccuguaaucccagcacuuugggaggcugaggcggguggaucacgaggucaggagaucgagaccauccuggcuaacacagugaaaugcugucucuacuaaaaaauacaaaaaauuagcugggcaugguggcgggcgccuguauucccagcuacuugggaggcuaaggcaggagaauggcgugaacccgggaggcggagcuugcaugagccaagaucgcgccacggcacuccagccugggcaacagagcgagacucuugucucaaaaaaaaaaaaaaaacucugagcuauauuaauggccuuuaaaauugggucaaacuaucaggaugguuuagguugcccuguuccacuagacuggacagccugucagaguuccucuuaaaucucccagucuggcauauacucugauaaccagugugccauaauucuuuuuuuuuuuuuuuuuuuuuuuuuuugagacggaguguugcucugucaccuaggccagagugcaguggcagcaccauugcagcuaacugcaaccucugccucccggguucaagcaauucuccugccucagccuccugaguagcugggauuacaggcaugcuccaucaugcccugcuaauuuuuguguuuuuuaguagagacgggguuucaccauguuggccaggcuggucuuaaaugccugaccucaggugauccacccaccuuggccucccacagugcugagauuacaggcgugagccaccgcgcccagccaauauauauauauauuuuuuuacucaugcaagugauaaagggaacugcauuaaucuuuuucauugucagaauaauagacuguucaggcauuauacauuuuuuauuucacucuggccagaaaugaccucacacuauuuuuggaguggagguuuauaauauggcaugacuaaacuaccuauagaacuuagaauacuuaccauuuuaucuuaugucuuccuagauggaaucauucuagaguuacucccucaagaacuagcaugaguaacuucauugagcaguauuuaagcagggaugggccaguauuugcaguagagaggaguuugucauucacaagagguuucagguuagucauuuaacaaaggccuacuuguaccacuguauuuucacaaauaaaaugaauucugugacugggcacgaugacucaugcccguaauaccagcacguugggaggccgaggcaggagguucacuugaggccaggaguucgagaccagccucaccaauauggugaaaccccgugucuacuaaaaauauauauauauaaaaaguagccgggcaugguggcgcgugccuguaaucccagcuacucgagagacggaggaaggagaauuacuugaacccaggaggcagagguugcagugagcugagauggcgcugcuacacuccagccugggcgacaagagugagacuccgucucaaauaaaaugaauuuuggggcuggggaggcaaaauuccauucagaucaccuguguacuucucuaauaaccgugguuaugacuuuaguccugucccaaacaguuacauaauggcuacucuguagugaucuauaucuuuuuuuuuuuuuuuugauacagagucuuguucuguugugcaggcuggagugcaauggcacaaucucagcuuacugcaaccucugccccccggguucaagugauucuccugccucagucucccgaauagcugggauuacaggcaugugccaacacgccaagcuaauuuuuguauuguaggagagaugggguuucaccauguugcccaggcuggugucgaacuccugaccucaggugaucugccugccuuggccucccaaagugcugggauuacaggcgugagccaacgugccuggccaaugauaaguaucuuuugaauuccaguagagagaaacaagguucuaguaaguaaggaagguuuuguaaaaaaauaaauagagauaaugcuaugagaauauaagccauuguuaaaagcucuuuuacugguguucugaaaauaacauuuuucaaaaauuaugucuggcagcugaggcuuuggcuguggcauacaucauccuuccaaucaguuucacaaaguuauuggauaccuacugcgagcugggcguuauucugggugcuguagauacagaagugaacaaauugcucucuuaauacuuuauguucuuuuggagugcgaagauaaagcaaaauuuaaaacuucugauagcuuuaugcagagaauuaauggauagaauagguaccuuggaucagauauucaggaagggucugacaaaguaaauuuaagcugagacuuaaaaagauuaaaaacaaaacaaaacaaaaaccagcccugauccuccaaaaucagggguaagagcuuuccaggcagaagaaauuuugaguacaaaggccccagccuggaaaacuggguaaaaugugaggugugugacacacgggccaaguggcaggcaggguugaguucacagaccgcuuuguaggccagguuaaaggcucgacuuucauuuuaaauguaauagaaagauuacauaguuuucagcaggggagugaaaggucugauuuuguuuuuuuaaugaucauucuacugcuguggggcaagacacagugacgggauagaagcacaguuauaaaagcuuuuguagccggagaugcugguggcuuggacaaggcugccaaggucaagaaacuuuguucuagacauacaccgcugugaagacauguggcuccauuaaggaaaucauccaagcuggacugcaguggcauaaucguggcucacugcagcuuggaccuccuggacuccaggcaugggccaccacgcuuggcuaauuuuuuugcauuuuuuguagccauggguuucaccauguugcucuggcuggucuugaacuccuauacucaagcgaucugcccacauuggccucccaaugugcugggacagcaggugugagccaccaugccuggccuguuuuuaauuuuuaaauggaagauucugaaggauuuuaaagugcuuauuguagagagauguuuagaaaagggagagcuuggugaugcuggaguugggaagagaauugcaggagcaccaccaucgagaaggaaggagggagcaggaucagaacccagaggccugguguuugagaagaggggaacaugugugcaagcuguugaggcagggagaaagaguaugugugcagggaggaguuuagaaauuuuuauggaaaaugaagaauccugccaauuggcuuucaucuucucaaagaaaagggacaaggcuauuuagugaaagaacuagaggagagaguuaggggaacaaagggagagaaagaaaguagauuugcaggauugugguaaaauguaacagucaugggagacugggggagcgacccacuagagaaaggggaagggaagauuguaggugaugcugaguccaagaaaggcuguugagcauguuuagauaaacugguauauauuuguuuacuuaugucucuccucccugccagcucaguagaugugaacuccaugaaggcagccccugggucuguuuugcuaccaccaccccuguccucccaaauacucacuacucagggccugauacagugcccuuucugcagaagaauauucgugugagugaaugaaugccuaccuacugguacccucaaguccaaguugagcaaaugugaaugaugcuuccugugguagcuuugcuagaugggcauuuuggaggggagaggacaggggauuugcagaggauugcuugagagugaggauggugauggcucuuaaaucuuaagcugaguaagaagccagugaagauaagagggcugguaguugggaagaaaaugggagaaucuguggauuacaguuaacaggugaaagaauuaaugauuccuggggugggaagcuuuuggcaaggacaggggauugguaggauaggagaugucuaaauuugugauuguggagguaaauauguaauuguggagggaaugacaaaggucaggguauguccuggggagcaugaaguggaauggaauagaaggucacugaggagaagcuuaagaaacaagccgggcacgguggcucacgucuguaaucccagcacuuugggaggccgaggcaggcggaucaccugagguuaggaguucaagaccagccugaccaacauagagaaaccccgucucuauacuaaaaauacaaaauuagcugggcaugguggcacaugccuguaaucccagcuacucaggagacugaggcaggagaaucacuugaaccccggaggcagaaguugcagugagccgagaucgcgccauugcacuccagccugggcaacaagaaugaaacucugucuccaaaaaaaaaaaaaaaaagagagagagagagacccgggugucaggaguauggucuauauugucaccaaaaaugacaggaguuggggcagagagcaacuugggggccaagccaggugcugaaguucucagugagagaagccaguggucaaaugggcccuuuuaaugugaaaccugcugugagcaggcuguaaugucuaaauucauuuaccuucaucuuguuauuagccagaguaaaaauaguacaguuagcuuucccaccccauuccccaggcugccaccucuaaggauaacccugcuuuugcauaugcuuguuacuaucagaggacuuguccauuucuuucuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgccuggcuaauuuuuuguauuuuuaguagagacgggguuucaccuuguuagccaggauggucucgaucuccugaccucaugauccacccgccucggccucccaaagugcugggauuacaguccauuucuuucuugaaguugacuuaugccaguuuuaauucugccuuugacagcucauuauuauauaaucuuuucauuugcuauuuaaaacuuccaucacacuugcugccuagguuaguuccuacucuguauugggugaccucuagcuuuugagcugguuauucugacaucuuuuuggcauuaaaucuauuucuuucccuuuaggauuuggugucauaaugaaaacaaguauuuuuggcuuccuuuuucuuuaaacugaaauucuuuugaaaacaacaaaagcaaugucuuaguucuuuuuagaaaccuguucacaguuugagauuugcuuauauuccugguguuggugaaaacuguguuguuaguggaaguuuagagauuaugacauccaauuugccugauuuuaaggauggaaaaaaaugaggcugagauguaugacuacgcacuaguugcagaguccaucuucuggcuuccaguuuagugugugugugcuuguuuuuuaacuauaccaaaugcagucaggauguuuuuuuuuuuuaaucuaauuuuugcuugcacaucaagaaaggauggucuucuuuuuuuuuuuuuuuuuugguuuucuuuuuuuuuuuuuuuuuuauuauacucuaaguuuuaggguacaugugcacauugugcagguuaguuacauauguauacaugugccaugcuggugcgcugcacccacuaaugugucaucuagcauuagguauaucucccaaugcuaucccuccccccucccccgaccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggauaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcauguguaggauggucuucuuaauaauaaauauggggcacauguucucaggaccuccuggggcugugucacacaaauaauaaauauuaaaaauaaaaauuauaauuguauuuuccauuucuagugugacagaguuaugggaaacauauguaaaucauaauauccucucauguucuucacacuuguaagagcauuaagagauggacacauaggguaaauauuaaucaguuuuaggaugaagacaguaagaugaaauuacuuguucauuuaacuuauuaagcuaauucuaacauuacugcaugcuuacuguaugccaguuacuguucaaaugcuuuacauauauuaacucauuuaaucuucacgauuaaugauguguagauaccauuauuuaaccuaguuuuaggaauaagggaacagaaaggcaaagagaugaaguagauugccccagaggcucacacaguggcauuuaggcauucugacuggagccugguccuuuuuaaaaaauguauuguuacaucaguuacacacauuuuugggguacaugugcuauuuugguacauauaugcaauacguaaugaucaaaacaggguaauugggauaucugucaccucaaacauuuaucuuuuggagccugaucuuuuaacuacaacucuaagagugguagagaauuguaguugggucuugugaguucaaguccaauguauucuguacuguauugucucugaccaugaaaauaaguacugccugaacccaacagugugguuauaugaacgacccagcgaucgaaagauaaacuaugaaaacaaaacagaaguuagucucccaaaaaugaaaccaaaggaaaguaggccagagguuuugauaauccacuagguugguagaaggguuaugcuauugaaggauaacacuucaccuuuucuuaguuauaaaugaccuuuucuuauccaucuagcccauuccucagacucuauauuaccagagagaaaggaagaaacagaaaagaggaccccuuguugaguuuagaucuccugaacacacacaggaucaguucagaaguucccaugacacagggcauugagagugagcuccuugccugguuccucacccaagaagagacaggcccagguccaucucuccugaguaggaaaggcucagauuucugaagagauuucuacccgggcacaggcugccucagguggggccuggcugucugagguuagaugaaaaucuaucagauuguggacuccugcacauagcuggccaaugucugucacuaguggagcuggcagcacccccccacccuuacucaauuggaacaccccuacucuggucacccugugugcuaggaacagagauccaaguuauuacccuuaaauaauuuauagucugagauacugcaagggaagaugagauucagucuuuaauaagaauauuuuaaacaauuauaccuacugaaaaaauagaauuaaucaguuugguugugaacagucuacuuuaugugggcaguuguucugaagauagacgaucagaaugacuuaauguauucacuuaacuguuuucucacaggaauucauaagcuuauaaugcaauugcaucagccacagcugucugaaccaccuuagccuaggcuuauuuuaucccugggauguagcugcuguuuuggccuuuggugaucuucacccguuuaccguaggguggauuuaccuugauucacaagucguuugucuaaccucuccuuuugucaagauaauucugacaggugaaauuucuggugauuggcccaaaguauuucaucuacccacaaauuugaucauuaauauccucucaaauaaagggaacaaagauggaaaaauaggugaagcuuggccucauuuauuuacauauugaccccaaugucagaaguuacucagaagugugugcaacucuguauagaccccuuccugggacuggacacagaggcugaaauaaaaaccaguuuuucagcaugacuuagcacaauguuauuuauuuucacugccuauuagccuaugggucaugagauuuguuauucuagagcaguugaguauuggaguggaacaagcaaaagcaaggcauauuuuucuguuguaaucuguacuuuuuauuuuuuaagauauauaauaauaguuuuacauuaagugugauuuggauuccuucuccagaauuauaaauuaccuaauucccuucugcuaaaagacgcaggacagagaaggguaagcauuuuagcuggacauuuauuccuguuguacgauccuccccauccccuuuaacgagugcuagaacuacgccagagaauaacuguccaaaaaacuuaaggaguucugauuuuaaucuggucaaaucacugaaauauguuguuagaaaaugucugguaguggccgggcacgguggcucacuccuguaaucccagcacuuugguaggcugagguggguggaucacgaggucaggagaucaagacgauccuggcuaacauggugaaaccccaucucuacuaaaaauacaaaaaaauuagcugggugugguggugggcaccuguagucccagcuacuugagaggcugaggcaggagaauagcuugaacccgugagguggaggcugcagugagccgagaucgccacugcacuccagccugagugauagagugagauucugucucaaaaaaaaaaaaaaagaaagaaaagaaaaagaaaaugccugguagugaauaaaaucuuaaaucaugaagauuaaaaauaaccugcuacuucuacuuauguugccauaaaagcaguuuucaaaauauguucucuuaaaauaucuugaaaauaguuccuggucuaauggaaacaaguguugggaaaauucccuuguugcagacauauucauuaaugugaugauagcauugccaaaaggaaggagaacaugccagggccaacucaacacaguccugagaacauuccuuuuccgaauuucuggcccguucuuucucugucuccccccuccuuguccaggaguuccauuguuggcaucauuauccagaauguaaauggcuuugccagaaacacugcccacagcuugucuaagaacaaaugucaaggagauaugcuuuuuuccauguauuugcuuuggauauuuuucuaacaauuaagccugagggccaggugcaguggcucacgccuguaauuccccacacuuuuggaggcugagguggguggaucacuugaggucaggaguucaagaccagccuggccaacauggugaaacccuaucucuacgaaaaaauacaaaaauuagcugguugugguaaucccagcuacuugggaggcugaggcaggagaaucucuugaacccaggaggcggagguugcagugagcaaggugcugcaccaccacacuccugccugggugacgaagugaccuuaucucaaaaaaaaaaaaaaacaccuaguauuggaagagaucauuuuaguuuagaaaguagaaaguuucuugauagaguuggucugguuguguucaucccucaaaggcaagguuauaaacuguuucugccuacuuuagaagagucagaggguuuguuuuguggcucuuuaugguauuuuaucauguuggugguuuuguauucucuagaaaauuucuguaccuaaaaaugcugccuuacagaauuaauuuccuuuaaggacuuaacucuuggauauuuccccauaauuccucuguucucagagugcuugccauuguuauuaaaugcuagauuuuuagagcugauagggccuucagaaauagaguaagaguggagauuugggagaucauauaguucaacuauuugucuucguagguaaagaaacagaccccacaaggugaagugacuugcccagggccugcaguugauuaguugaggcuagaacccaugucccuguuuaguacuuugcuuuguggugugauucugcccucuguacuagugcucagaugguguucuguacuuagcaggggcacuggagacugagcuccaaaccauuuauuacuaaagcguauguuuaccaaguccuuuuugguucuguuauuuauuccuguacucaacuaagccaaaucuagauuuaauugaaaacuguauagacacuguuaauuccaagugugcucuccaggucauguccaaugagggaggcaccuuagucuuucagagacguuuugauaaacauuuaaagcuuaccauaguuauuugcuugacuuaacaccuuuaaaugccccguggccucagaucguugaagcauaaugcccuguaggauucccauuuuguuuugcuugagaucugccauuccccagcacucaggugcugugagcugauugagcuguuccccaacuagccuauuuuaggacacaagccauuuguuaagccaaguaugugaauaugucacuguucaggcacuagucucaguggcccccccaucucccuugaauaaaagccaguguccuuaaaagggccccaaaugcugaucaccucugugacaucacuucucauuuucugccccuuuuucaaaucccuucaguuucaggaaaaaacuucagagcaucaggcaagcuccuaaugugcuuugcacuuggcuguucccucuauagugaccuucuccucuccucuugguaccagguggcuccucuuucaccuccuucaaagcaagucacuuucucaggaagucccuuccugaccaucucauuuaaaauugccaccccgccccaaccuuuccauuucuguuuuccuccuuugcuguguuuuucuccauaaugcuggugaccuucuaauguaggacuuauuuuuucuaaagaccuuuccuuacagguauuuccccuuaaguccugugucuuugaguauugguuuuaguuuaaaugaaaacuucccagugcuucucaucuguagccagcauugggaaccuuugccauagacguugcuucauuagguguuaguuuugagaguucucacagaggcaggauuuuaaguaucaagaacguauuuuuaauucuuaauaguagcuucaggcaauauuuuucauauaguaggaccauucucuugcauuaaaccacauaguggcucagcauuguuccccacucaucagaaagcuucccugcaguagugauagcagcauacuccuauauauaacugaucuugaggaccacguaccuuauaaccugagguuccucugauuuuagggggaggguaaugaauuuguauuauuugaacaagaguguuaagauacgagauuucaaauaaaaugguugguuuuacuggcuuuuucuuaaaauaguucagcacuaguuaaugcuuguguaauucagucuauuuuagaauguuugauacuauguauaacuuuuuuuggaaacggagucuagcucuggcuuccaggcuggagugcaguggcaugaucucggcucacugcagccaccucccagguucaagcaauucuccugccucagccuccugaguagcugggacuacaggugggcgccacaugcccggcuaauuuuuguauuuucguuacagaugggguuucaccauguuggccaggcuggucucaaacuccugacaucaaguaauccguccgucuuagcaucccaaaguguugggauuacgggcgagagccacuguggccagcugauacuaugauaacuuuuuauuucggaguuuuuuuaagcucaacuauuaaaauuacacauuguagaaaugucagagagccaaaagugcaaguagaaauaaugggagaaucuugcaaacaugacaaccauccacaccuguuuucuucuagccuuuucccauugcugugauccuaguucugguucagguguggugagguggugaugagauuugaaaagugcagcggagaaaauacuaccaccacuaagaauucuacacuguuaacauuuguacuuacuuucaguuucuuauuuaugugcauauguuuuaaacagagcaaauaauauagaagcacauugucccuuuuuaaaaggaauauauuaauaguguuaaagucuuuuuuuuuuuuuaaagacagucucacuccgucacccaggcuggagugcaguggcgugaucuuggcucacugcaagcuccgccuccuggguucaagugauucucuaccucggucucccgaguagcugggacuacaggcacacgccaccacacucagcuaauuuuuuauuucuuuuuacuagagacaggguuucaccauguuggccaggcuggucuugaacuccugaccucaggugauccacccaccuuggccucccaaagugcugggauuacaugcaugagccaccgugccuggccagauaaagucauuuuuaaccacuguuuccucuucuguucccuuuuccuaucaugacccuggcccugugcccuaacugaaacaauuacuuuugcaaauuugguauauguugguucaguacaguuuuccuauacuuguuaccauggagaauugguaguuguuuguuuuaguuuauuuaaauaaccucagccuguaaauauaacauccugcaacuuaaaaaaaaaaaacaaaacucagcuuuagauguauacaaguugauacacauggaucuacuucauuacccuuggcuguauaggacucagguagauggauguacuccccuuuauccaacccuaucccauugacaggguugaauuuggcuguuggcuuuuauaaauaauauugcaacaaauacucucauggggcaucugggacauguguauuaguauuuuucuaaaguuaauguagaauguuuuuuacccuaauuuuucuccucuuaauaccaagacaugaacauuucccauuauuaaaaugucuucauaaaccacaugcuucuuaaaucuagacuuugaaacaucuuuaauuuccuuaaugaaaaauuaauauuggacacaaagauuuuuuuucaucagaguaacuuaaacaucacauaggcccucuugauuguaguagauagaacauuaugcuguuucaacacagagcauuuaaaaacaaaaguuaaaagugugagugacuagaguggucuaagacuggacuacuuggacuugguauucuuauccccuguuuucuacuucaggggaaguuucucagguuuuuggagacaaucucuguagcgccucacuugaggcuccuccuccagugccauuucucugcaucuuuccugacucuucccauuuuacuccgccuacuguaucaauacuuuauucagauugcagguauuuauuggugucucuugucccacugccacagugaccuccucaagaauagugaacugucuuauuuuuauacccuauccaagcacaaugccugcgguguaggugcugaccaaauauguucugaaugaauaugagagagagagacuguggggaugggggugauggaggaugggggucggagauagugguggugauacucaccuuaauaaggaacuucagauauugaaaguguggaacagaaugaguccuaaaaggaaaugaagugauaaggaugacaaaaugacaccuuugacaauggaucucugcuuuagaauauugccauuugcauauauacugacugacugaauaacugguuuuauuaauuucuccuugaaguucaaauggccauauagcuauuaaaguguguacuugguuugcuaggaaaaauuuuaaaaacuuaaaccuccaacagauauagccaacuuagaguauuuuuuuuaacuccuugcuugguugccccaauuuuaaucaaaacuggguuucccugaaugaguagacuaauguuaaaggaaauauuuuggucacugcuuuuaggaaauccuuugugguuugaagugguauuccuuuagcauuucaacaguuucauucauguuccgugcacagugcagccaagugauaccaguaagugagcgucagaaggagaaguugaaaugcagaaccuccagauuuagagcuugaacaacaaaacuucugggagagugaaguuucuuaacuuuuaucaugacacuggcuaugaaccauuuaguaguauaauuuaucuuugagcaguaccuucauagcucagaaaacaguugcuuuaaugauuguuuuguauaagaagcugcauuucucccaguuugcucauuuguuaauagaaugcugauguauuccaaauaauuggagcuaucaggagaauauaauguuuaucaguaaugaaagaucuaagguugaaaguagugauuuauaaguauuaucaccuuuucccaauacugaaauuguuuccaguacugaaauacuuuuauuguucucuggauacuuuuugcugcuaauuaacaucucuuuuuacaggauucaugaauaaaauuuuccaucccaacauugaugaagcguaaguaacuauuuuaaaauguuucaauuuuagcagcaacugcucaugauuaguguuucucuguguuauaaaaagccucgguuaucuuuuuggaccuuaucaggagguaggacuguaugaauggucauguaaaugauagaauccaaaggauaugagguucucaaucacuuaguucacauucugcuguuguaccacuuauuuuuuuccauugucgugacuggguccuucauuuuucuuguuacccagcaaacaguaguaauauuccacaucucacuucucuuuuuguagacacaguucagagaucuguuuucagccuacagauagacuauuuucagaucuuauaauauuuucucaauucuugauagauaguaaggcaaaaugacuauaguuucauuucaguuaaugaaucuuauuuauccccuucuuuccuucuaauauuuuauuaaugauacuuuaaaauauuccagcauauccuguuuuauacuucuagugcuguuuagaauauauuauuguuugggaugcaauuuuaauuugucauggcacuaaguuuuacugucucucacaaacauaccuaacagguuuuucugcacucugugugaguagguuguauauauacauacaucaugccccuuaguccuuuaauauuaauauuuuauuguaucaguuauccuaacaaggauauucucuuaucuauccacaguauauaguugucagauucaggaauuuaacguuaaugcaauacuuauuuaaucuacugccauauuccaguaacuuacuuuuuagcacuuuuuucuuucaauaaaggauccagucuagaaucacacauuacauuuaguugucauguuucuuuaaacugcuuuaaucaggauuaguuccucagccugccuuuaucuuuuauaaaauucacuuuuuaaaauaacauagaccaguuauuuuauagauuguuccucaauuuguguuugucugauguuuccugaucauuagauucagggcaugaacacacuuaaggccagaaaacuacaaaguaagaugguguccuucuugggguaucacauucagagacacacaaggucugucugccccuuguguucucagcaccugguucagguguugucugguuucuccauugcauaguuacuauuuuccccuuucagucuguaaggugacacuucaagaccugguacuauucuguuccucaucauacuuuuccccaauugggauucuuuuuuucacagaucuauuagaaguauuucucuugauaaguaaaaauuaguugccagauacaugcaacuaacuuucuaauuuuuaaaaacaugccauucuuuccaucuguuucaggucaggaacugugugucuagauguaauuaaucaaacuuggacagcucucuauggugaguuuggccauggaauauuuuuuggagauguugagacauugccuaaaaaaauguuguuuggcuuuucuuuucugguuuaagauguuuuguugguaaugggaagggauuuuugagggaccgacugggaaaguuugaucaguggaaaaaauguuuucucuuaaguacaaauauaucaguuuagcuguggaaguuuaaaaugauuuuuugagauuccaaacuuaagguauagugauacaugugcacacacaugaguacaugcgcacacacaugaauacaugugcaaacauuuuauauguauguauuagcacauaauauauacauauuuugguuuuggaaaaaacuaaaacuacuuaggaaugucccucugaaaugagagagcaaugauauaguaagagguuuuaggggaucaucuuuucaaagaccaaaaccuccuuaugaaggaagaguaauuuagccuuaccuucagugcugaaauugacaccccaucucuuacagggaaucaacaaaugaauugcccagcucugcaaaaugcuaugcugaauaucccagagaguuauaaagagcaucaggccuuuccuccuuaucaccugguuggggagcugaaaauauguuaaaauacagucaucucuugguaucugcaggggaucaguucccagaccaccugcagauaccaaaauucaugcuuacucaagucccacagucaucccugugaaacccacugacauggagggcuagcuguauuuauugaaaaccacaugugaauggacccaugcaguucaaacuguguguggacccauguuguucaagggucaguuguguauuugaaguuaauuagggauacaacaaauaaaucuguuuuucccuccacauguccaaaucucaggcuucauagagucuaccuacuccagugcuccuaccccguauacuuccgcugauucuccagcuggaaguaaucucuggauaccauuacauuuuauagcuccuuuuuuaugguccacuuuuacuuucuacuguguauuuguuguuuaugccuauuuuuuugugcuacuagauuauuuccuaucuuaagggcuaucgggugugugucugauucaucuguaaggcccaggacucuuaucacagugcccuucaccaguauggguugaaagaaugaaugguacagguaaccauugcugagaggcacaagaaaagaagggaaagcucaguugaggcugagcuuaaccagggauggcugcuucuuguugaacuuguacgaccuuuuaguggucugagguagguaagacuucuuaguccagccacaaucugcaaguuacuuuugccagauauccuugaacuagauugguaaaugagaaucacagagaaagguuggucaccagcagaacacaguuaaucccugccuccaccugauugugccguucaaaaauuauuuucucuaccugggauauuccccccugaucuuugugugguuagcaccuucuucacucaucucacauauuacuuccucagagcaguuuccuuucccagcuacuccaucugaaaucacaccccuccauagcacagcacccaguuguauauauauuuuuuaauuuuaaaauuauuuuuuaauacauagaaacagaguugcacucuguugcccaggcuggaaugcaguggugcgauaauagcucacugcagccuugagcuccuaggcucgaacaguccucccaucucagccuccccaguagcugggacuauaggugcauacuaccaugccuggcuaguaccccguuuucaauaagcuucuaaaacugguauuuguauauuauuuaucuuauccccuuggauuguaagcaccaugagugaggacuuugucuuguucucgucucucucucucuauacacacgcacacgcacacgugacuguaacagugccuggugcacaauaaggguucgacuauuuguugucuuaaugagugaauuaaucauguccagaacuguuuaacaagagaguuuuaggggagaugauggcauauaguugaggcaacaagaaagaacauacacuccgagcuugauuaaauggauuccuuuuaagaugguuuuuuugguaaaaaugucucauggcaggcugccuggaauaucugauguaaugauguguuuucuuaaacuacauucacaucuuaaaaauguacauaucaaaauacugcaaucugguuccaauuacaaugaaguaaauugauguuuaguuuugcuaaagcuuuuaccauugaccagaaaagcuuugugaaagauguuugcugacugucaaguacuucaugucucagaacagguuuuuuaaaaaaauaacaguuucacugaauuauaauucacagacaugcaaaucacccauuuaaaguguguaauucaguaguuuuuaauacauucaguuauaugcagccaucaccacagucaauuuuagaacauuuucaucaccucaaaaauaaauguguacccuuuaacuauucgcccuaggcaaccacgaaucugcuuuuuguuucuguggauuugucuuuucuggacacuucuuagaaacguaauuauauaauauguggucuuuugugacuguuuuuuuuuucacuuugcauaauguuuucaagguugauccguguugcauguaucggaaguucuuauggcugaauaauauuucauuguguagauaaaccacauuauuugucagauaauagacauuuggguuauugcugucuuuuggcuauuaugaguguuauaaauauuugugcacaaguauuuguguagacauguuugcauuucucuuggguauauaccuaggagugaaauugcuggauaauauguuuaacuauuugaggacugauagacuacuuuguaaaguggccaacaugaguaaguuuucaucacauuuauaaaauguuaguguacuuacauuagcuugcaaagcauuuaauaagcagcaagaguuaaaccacguugguccaagugaacugaaagcagacuucuguguuacauguguaugaguuacugaacauguuccauaauacaggagugugagcacacuaacagguaagugcaggaaaacaagaagaaauauuuucagaguauagucaaaaguacacugagcaugggagaauuguuuugacauuuugcucaaaacuauuucugaagaaaauucaacauuucuuucacggaaaguuuuaggaacagguaaauacaauuauauaaaguacugguagaauauguucguucagaugaccuugaaguguuuuuucagacuuaucugaacuugagaucugaacugaauuuuuauuagaaacuguuaaagccucuggcauugaagguuaguucauaauuggugaguucugaaucacuucauuuccugcagugguuccugagagaaucuuaguucaaaggacugcccccgccaaccccugccccgccaaaaaaaaaaaaaaaaaaaaaacuaacacuaaauaacuaauaggagaaaguuggcgugucaacauaaauauucaacugaaaagcaaaaggcuaagccuggcaccuaaaacuuguuucaacacuuuccucugcuguagauucgaugagggagcagggaguggauugugaaauuuccugccauuuaccuugccccaggacauguacuguucuguggguauacauauuuguagcguaacaacaauucacaguugaaauuucagauguauguuaaucauagccugauauuaaacaacauucauguuagcaguaaauuuaguccucuguccccucacacccuuccccgccauugauuucugguaagccaguugacucauugcuucuguucuuauccuguuuucucuuugccaaguguaugugcaauuuguuuauucagaguucaaaauugguauaauugugguuuacucacccaguaauuuuuaauuuuguauuauuuaaccuuacaagagagcuaauuauagugaggaaucggauuaauuuuguaagaugcuugccaucaguaugaaguuaucaaguaugaaguuaucuauuguuauuguuaugacauuaaacagaaaguagcagaugaccaaagugauuuuggcuuccugcaugauagcaucuuuuuuuuugcaucccuuccugcucuuccagacagcagugacagaagcucugagaaacauaaaauguagccaaggggaucuggauuuccauuucaaaacaaauuaauuuuaaggacugauaggagaguucauuaagccacagguagcuuuuuaagcacucuucuauuuuccaguuuuccuuuuuuucuccaaaauauauuuuaucuguaguuggcuuaucacccugcacuccugggggcccaggugccuucacugcgauacagcuuuaaucucucucucaucccacccuucuggaccaggcaugcuugaucccugcaaauguguuucucucuccagcuuucauuuuacucauucuuugacugccuucguaaauuauuuauaugauggauuaaguuguaggcugggcacgguggcucaugccuguaaucccagcacuuugggaggacaaggcaggcggaucaccuuaggucgggaguucgagaccagccauaaccaacauggagaaaccccaucuuuauuaaaaauacaaaauuagccaggcgugguggcgcauaccuguaauuccagcuacucggacagcugaggcaggagaauugcuugaacccgggaggcggagguugcagugagcccagauugcaccauugcacuccagccugggcaauaagagcaaaacuccaucucaaaaaaacaaacaaaaaaaaaaguuguggagaagugagguggaagacaauuuucuuaugaaauugggcaguuuacauuuucacucuuaggguugcuagccaguggacuagauacuucuacucuuauuuugcuggagagaaaaaucaacauuugggaaaagucuuccccuagaguuaucuggggaguuaguaacaggcaaauaaaauugacuacaacagaaggaauacuucaaggacuuugagauuaggcaagagauacaaauuuuuuuuuuuuuuugagacggagucucgcucugucgcccaggcuggagugcaguggcacgaucucaguucacugcgagcuccgccucccggguucacgccauucuccugccucagccucccgaguagcugggacuacaggcaccuaaaauuuauuuuaccaggcauuuagaaauuuaaaauacaaauuuaacacuuaucccauccccuuuucaguuagauagucugugaaucuucccaaauaauucagauuuuggcagaagguauaucuuaaaauaaugcuuuaugcuggauuagugcaugcuguuuccuaaacauuuuaguguaacuacacagauaagaaauacauguaugugucuucauggaugauuaauuggccaacuacuauuugaacagcuugagaacuucaguauugaucuguccauguugaaucacaaacgucauccugccuuuggaacagcuggaugucauuauuuguagauagaggccaaguagagcaauucuguccaguacuauugggauaaugucaccuguuguacauaauaaagaaaugugcucaguuguggauuugcgcuucaacagugcuuagcuagcuccguaaccaaccuucuuuaucugucugcuuggaaaucuucagaugagguguauguggcucaggagucuaacuaguuauauacauaaaaauggagucuugcuggcuuugaacaacuuaguggacauucauuaaaaauaccacacucacugguggucagcuuuaaaaccauggggugguccaggcuuuuuggaucgugggacaugagccagccaggguauggcucugaaagacagccacagcuaugcucuacuuucguaggggcucugauuuuagggcuuguuucauucuugauuauauguaaauguaaccuugauuuguuuuaucuucauucacuuacgauuacugaguuauaaagucuucccagcguauggacacuuggcuuguaauugcaggaaguuaccucuuguuauucuuuucugauauuaacaacuaaauuauugucuaguaauuacaagcuugaauagcgaguuuuaguaugacagcaagacuauccagcuagcuaauuacacauuaacugcccucauuucuggaagguuaauaacaaauccuauuaccauguuuuagcuuacaagcucuuaagguaagcaggguuauaagguuugaacgaggaugaauuaccucuaaaaaacacccaaauagacgagaauuguuuugagauugacaaugcaacaagagcaguguuuuugaugaacaagagcuuguuuucuucauugugaucuaugcaguagcacuuauuuucuucugcaacucucugaaguuuaaauauguuggggggaaaggggcuacaauuaggcaaugaaugggaaauuaccuuuuaagcggguuuggaaugcuuuaaaaacagucuauguccuguaacuacacaccucaguuugguggccugguagccuggcccugagcagaauguggcugguuuucccaguuucagcacccugcauccaucuguccaucuaucuuuucucuucucuuuucucuucuuucuuucuuucucucucucuccuuucucucucucugucccuccccccaucccccuucccucucucucucuuucucucucucucucuuucuuuuuugagacagagucuuacucugucgcccaggcuggagugcaguggcgcaaucucggcucacuguaaccucugccaccuggguucaagcaguucuccugccucagccucccaaguagcugggauuacaggcgccugccaccgcaccuggcuaauuuugugguuuuaguagagauagcauuucaccaucuuggccaugcuggucuugaacuccugaccucaugauccaccugccucggccucccaaaguacugggauuacaggcgugugccaccacgccaggccagcgcccugcaucuuucauauugcccuuucccacacagcacaggaacaccuguuucuagcuuugaauacuuaaaaaccaaaaugcuacuacugagauuuaaauguauuuaucauguauguugcaaacauucuuugaguguuugaauuccuacuaauuguuauuuuuuucuuuuuuuuugagacaaggucuugcccugucacccaggcuggagugcagcguggcucacugcagccucaaccuucugggcucaagugauccuccugucucagccucucaaauagcagagacuacaggcaugcaccaccacaucaggcuaauuuuuuauuuauacuagagaugggggugucacuauguuguccaggcuggucucgaaccccugggcucaagugaucugcccaccugggccucccaaagugcuaggauuacagucaugggccacugcacccagccaccuuuuuugagaggugggaggagggaagaguuugguguguuuuuuaagcaucccacuucuuuucggagguguuuucaccuguuucuguuuuuuuauuuuguuuuguuuuguugccugcauggcccucuucauuaagacuuuaucuuuuaaagauccccaugggcuaauaugagaagauaugugaaucugcugagcuuagacuuuuuauauauuuucuccacacaugagacccucucagucaaguaauuguaugaauucuuuaauauaccuuuuaguauuugguggcggguuauauuaucuuaauugcagcuaguuagccuucaguaaacuaggugcagcauugugagcccuguggccaguugggccugagccacagcacugcaggaagucugguggguugcuucagcucuccaccugugugcccucaaaacagguggagaaaugggcuuuuugucacugaaguugaguucaaauuaauuguuuuauuauuuuauuuuauuuuauuugagauggagucuugcucugucacucaggcuggagugcaguggugcaaucuuggcucacugcaaccucugccuccuggguucaagcgauucuccugccucagccucccaaguagcugggauuaccggcgcccaccaccaaacccgacuaauuuuuguauauuuaguagagacaggauuucaccauguuggccagguuggucuugaaccccugacuucaagugaucugcccgccucagccucccaaagugcugggauuacaggcgugagccacugcgcccggcucaaauuaguuauuuuagagaauauuacuuuuaaucucaaaacuguuucuuugaauucugccugccuauccgauugguuuuacugaaguuuuccuugaggggcugucugucaucuuuuagggcccucuguuugcaaguuuuuuucaaaaauaacaacugcuuaguugugugcaguguaggacucuuuauagguuuuugacuacucuucuuuucuuguagaauuucacugucuuuuaauguuuacagacugcaagcaggauaaaauuaaaaauucaaccauuauuaauauugcugcuuuguaggagcugguaaaggaguagaagguaaagaucuauuaauuauagugucuaauacacccuugaggaaaaucuguuaacuccaaauuauuaaguaccuaaagaaaucuggagaucuuaauuuauuugcccuauuucaggccuuaccaaaaaaaaaaaaaaaagcuaccugguuuuugugcauauaguagauacccaccaccaccaccaaaaauaauuguggaaugaaugagauuucaugguuggcuuuauuuugggcacauauuguaaaauucaugacuugcguggcaguucaugacgaauucaauacaguuccuaaagucaaccaauggaauuuugaaaggucaacagcugcuuuucucuaguagucaaggaugugaauaacuugggugaaauucccaggaguuucaacuauaaugaccaaaaguucaggggaaagagaucuauguaagucacagagggaaucaucaguucuagacaacaauugacuugugauuuuuguccauguuuuccucuaggugugaacaggauuuuucuuuccuuuccugucagcccuguuccuuauugaauuacagaacagauaaauaccuuagacaguagugacuaucccugugauuuucggcuuggaaagccaggaguccuccuccagagggagagggaugaugaaagaaguuuggauagcaugcuucuggaggaugcagaauuuugauuggcaaauaaucauuguacauauucaugggguacauagugauguguuuuuuguuuuuuguuuuuguuugagacagagucuugcucugucguccaggcuggagugcagcagcgugaucuuggcuuaccgcagccuccaccucccgaguucaagcaguucuccagguugcagaauuuugauugagggcaagaggaacuuauuguuugugggaaaugaccuaagugauuguuuuaaggaaacuuucucugauuacaaaggcgagaguauagagccuuuaaggccauuuaguagauggcugcccugauccagggcuggaaugauauauugguuuugacauaguuacaugccaggggaaauaaaagaaaaacuagagacauuucugggaaacugagugaguacauggaagaaaggaagaacaccuagccagauuccuuccagaggcuuggagccugagagccagggcguuagagucaaccuacucccuucauuaggugaagggaauggguuuucaggaaaauaaucuuagacauguaaaguuugauaagacuacaagacuagacauaugaaggaccaguuauauggauuugguaguuaccaacauagacuucuuauuuuucuuucuuucuuuuuuauuuaaagagacugggccucagcugggcaugguagcucacgccuguaaucccagcacugggaggccaaggcgaagaggaucacuugagccuuggaguuugggacuagcuugggcaacauagaacuugucucuggaaaaaaaaaaagagagacugggucucacugugucauccaggcuggaguguaguaguugugaucauagcucacuguaacuucaaacuccugggcucuagugauccucccuccuuagccuccugaguaacugggauuacagguacaagccaccacacccaguagacuuauuccuuuaaaauuguaggauggccaggcgcgguggcucaugccuguaaucccagcacuuugggagucugagguggauggaucacccugagaucaggaguucgagaccagccuggccaacauggcaaaacgcugucucuacuaaaaauacaaaaaauuagcugggcgugcaccuguaauccagcuacucuagagcuugaagcaggagaauugcuugaacccaaaaggcagagguuccagugagcugagauugugccacuacacuccagccuggggagauagagcgagacuccagccuggggagauagagcgagacuccgucucaaaaaauaauaauaauaauaauaauaauaauuauaggaugacggcuucccgggguaacaguguacaaagcuaauucuuaaaaugcaaaugccacagaauuugagccgcugugcaggaugcugaugucuuucccgauaaguuuuuuguuauuuguuuuuaacaggauguugggcuucugggggacagguaguagaaggagaaaggggaugggguaagugggauugagaacggaagaauggcuuugaugguucuuggcacuuggcaccacuugguggugguuucugaguuacagcauguauuuuucaguauuaaguccgaaaaacaaaugaagaauauuuagguaaaagucuccaaaaugacugccugugugcuaauugugguucccagugaggcagagcaugucaagguuuggguauccacaggauuuuaaccugcagaaagcaguguauauuacauuuuuuuuuugaguggggggugguagagagagggucuugcuuugucacccaggcugguaugcaguggcaucacaacauacugcagccucgacccauccaccugccccugacuugagcaauccucucaccucggcaacuacugagcaccuacucuccugaguaguuggaaccacaggcacaugccaccaugcccaauuauuauuauuauuauuauuauuauuauuauuauuauuauuuuguagagaccggaucucccuauguugcccaggcuguuauugaacuccugggcucaggccgucuuccugccuuggccucccaaagugcuaggauuacagacaugaaccaccuugcccagcuugaaauuuuccauuuauuucaaaggaaauagaggaaaaagaaauaacuuguggucacugguucauaaauagccaagaauaaaacaugagaugugugauucauccccucuuguguuuucuccuucaagcccugcaccauuucauugugagucaccuggaauagggcaauuuuacuuuaagaauugguacauuuuuuucaguguaacucuuuuuaauuaauacauauucuuuaagggauacagguagcugaaaugucuacccuuugaggaugucauauuuguauuaauaguuuaguucucuggugcaauuugaaguauaucuuauagucacuuuuaguaauguguguuacuucccuguaaggaauagcaauguuauacuucuccuuuugcagugaagaaauugagauguagaaaggaagagaccugcccaaggucaaagagcaaggcaguggaaagccugagauuagacuuguggucuuuuagauuuuucaucuguuguucaccacugaggagccagcuuucuguuugcuggagacaguucagccuaauggaauuuucucugccagauguccacauuguguuaggugaugauucuaaccauccucuaauacccauucuccuccaaaguggcccuuuaguuccccuccagaacagaucugcuuuugacugccugugguuuggcacaccucugccuagagauaacagugguaacagcagugugcagaaaagaaagugggaagggucagggaaugucacuaaaccagagucgagcuguuagaggugaacauuuucuugcaaaaaagaaccuacgagcaaauggcccuuuccuucccgucuauucuuuggggauaggggaucaugggccagguaguauuuccugugcauuuugcacacagaugucuguaucacacacauacagaucccauccaguccuaaaccagaagcccugggguagguaugaagcugcaaccuuaggaugcuaagcaaguuuuuggaaaaacuccacagguaauugugauggacaagcaggaccuagacuuagcccagaaccacugcucuagacuaagugaugcuacuuuugaugauaaguuguuuaugauuugggagucucacuccauugcccaggcuggagugcagugguacaaucucagcucacuacaaccucugccucccagguucaagcaauucuccugccucagccucccaaguagcugggauuacaggugcccaccaccacgccuggcuaauuuuuuguauuuuuaguagagacaggguuuugccacguuggccaggcuggugugaaacuccugaccucaggcaguccaccugccucggccucccaaagugcuaggauuacaggcaugagccacugugcccagccuguuuuuaaauaguaaauaugaauauaaauuauaugccuaaacugagauaugaguguuauaauuuuaacauuaauguaagaucagacugaagagucagugcuaaugaaccacauuuugguucuaauugagucuaaggcaaaaguaagagcuguuugcucaucauaaaccauauacucaggaaucuugggacuuccuuuaaaaguuaagacaggcggaaauggggucggcugacuguacucuacagguuuaggucaacuguaucuggcucucuuccuuuaaaaaaauugaagguuaauguuuuuagauaaagaucuuugaacugacacauuuuuaucguuauuauuaucgacacauuuuuaucguuuuaucauuaacaaaaaucuagggaaaaaguguucuuuauuuuucuacagaugaguaucuuuauuuuauucuugauuuauaguuuuagucuucucugccaguguauuuaucuugaaagaagacuuucugcacaucugcacauuugagagaugcuccuuucagaagcacccuuaggaguaaucacuguguuagccacuugcaggaaggccuuauugcuuuaagauggcagagccaucacauccuggccucccgaaguugucaucuucacccaaaacugggccucauguguuuccuuuucugcucuucuguuuuacaggugugacucagcacuucuguaaaauggaucaaaaauguguuaaugcaggaagacgguagauacaggaaggaagaaccaauaauuaaggguucuuuuauuuguuuggaacaaauucauaggcaaagccuuuuauugguagcuugaggaaacuuaaaaguaguaggaaaggguauaaaaucucuuucugggacacgcuaaacuccuaguuuuauaacacguugucugugauauuucucuagcccugaagcacuucugaacauuacuucagaacauaaaaccuaugcuuuguuuuuaaagguuuucguuguuauguaauagcauccagcugcuaauccuuuugagcagcaccuguaauaauaauauggcaggaggagccuuccguucgcugugugcaggugucugcggguuaccuccugcgguggagcugcaugaaaacaagcacaccgucucugugaauagccacagaaacaucugaacguccuuugcuuagcaugcuucuuugcacuugugagggauucuuuggggaggagggugaucaucucugauccauggauuuagcuucccugccagcgaugguaugcgauuuugacccagagacauggggagcuugugccuucgugaaauuugcggcagcggcaguguguguuuuauccauuaacagaggcagcauaguggaugagcucagguuugaguuccugauccauacuuaagcucugugugccucaauuucuccaucuguaaaauggugccuaccucauugacuguagugaaauuaagaguguauaugcagaccauggaagaguuccuugcuuguaguaagcacuauguaagcauuaaccugccauuacuguuaauauuacuguuaaugggccgggcgcaguggcucacuccuguaauuccagcacuuugggaggccgaggcgggcagaucacgaggucaggagaucgagaccauccuggcuaacacggugaaaccccuucucugcuaaaaauacaaaaaaauuagcuggauguggcggcgugugccuguaguccuagcugcuggggagacugaggcaggagaauggcgugaacccaggaggcggagcuugcagugaguggagaucacacuacugcaccccagccugguugacagcaagacucugucucaaaaaaaaaaaaaaaaaaaaauuacuguuaauguaacuauuguuuaacuuuucccugcuaugggaucacauucaauuguaaaacuacuguuuuuuguuuuuauuuuuguuuuuuugagauagaguuuugcucuuguugcacaggcugcggugcaauggcgcagucugggcucacugcaaacuccaccuccuggguucaagcaauucuccugccucagccucccaaguagcugggauuacaggcaccugccaccacacccagcuaauuuuuguauuuuuaguagaaacgggauuucaccguguuggccaagcuggucucaaacuccugaccucaggugaucugcccaucucagccucccaaaguguugggauuacaguuguaagccacugcgucuggccuguaaaacugaauuugcuuaccuuuuggcauuuucuaccacugccuuaauaacucacccacccaaggauaaagauaagaaaauaaaaacauuuucagacuuuucauguuuuauuggauauuucaaacauaugccaaaauagaaaggacauauuuacaggaaaauguuauuuuuauuuuauuuauuuauuugagacaggguuccacucacuugcccaggcuggaguacuguggugcaaucuuggcucacugcaaccuccaccuccccagguucaagcaauucugccucagccucccaaguagcugggacuacaggcacgcgccaucacacccagcuaauuuuuuguauuuuuuaguagggacaggguuuugccauguuggccaggcuggucucgaacuccuggccuuaugugauccacccaccuuggccuaccaaagugcugggauuacaggugugagccaaaaauguugauuuuuaaaggcaaaagaaaugucauuugaaaugugaaaaguagaaguuacacaucuauugccuugagguagcuuuuuaaaauguuugucuuaugcauacacacuguacauaguuguaauucuagaaaacauaccauuuuauggccuuucucuacccagcauucaaguauaagcauuuuuuucauugaaaacaaauaguuuucaaugguuuuguaccauaauaauuguuucccuuuuuaaaaaaauuguagauaaaacauuggugaaaaucuuacugcagauaguuuggggguuauauaggaaggugauuuuuguuuugcuuuuuugauuaggagugucaggauuucuuucgugguacaugagaaccuuacuauaaaguggcucuuuaggaccguucugaagucagccuuaugaaggugaaauagacucugaugaaaucaccccaagucuguggcuuuuguuguaaggcagagcugcucugugucaauaccuggugugugagaacaggacgugguagcugucaugggacccucuagcccaucauucucuagaccugcacuguccaauacaggaucuacuagccaugugugguuauuuaaauuuaauuagaauuaaauaaacugaaaauuaauuuccuuauucacacuggccauauuuugagugcucaguagccacuuauggcuaguggcuauugguuuaggugagcacauauaaaacauuuuuaucacugcagaaaguucgguugaguaacacagcucuagauuagucucuaacugcucagcuucuuaaccuuacagugauaagagccaccucuuauagguaagauuuucuagagcaaaguugggcagaccuuggguacuuguuuuuguauauguaguuuuauaggaauacagccacaucgauuuguugaccuauacuuuggcugcuuuuguguuacaguggcagagcugaguuuugaguaguuaugacagagaccauauguggccugcaaagccuaaaaguauuugacccuuuacaaaaagguuugccuaccgcuuuuaucuagaucaggguuucuuaaccucagcacugcugacauuuuggucuagauaauccuuuguuguggggcuguccugugcauugugguguuuagcagcuucccuggccuucacccaccggaugccaguagcaccgcuuagauaugacaaccaaaaaugucucuagacauugccaaauuccauggggagcaaaaucacccuuggcugagaaccacaaaucucaagcaauguggcuuggcaaagcauucaucuguaauacugcaaaggagcgcccauuguuaaaagcaaaauugguugaaagagcugacuaaauuaaugaguaguuuuuuaugcuacuuaguauacuucagcauugucuccagaaacaggaauguuuuauauaaaacaugacaaagcagcuggaguggggcagagacauggaagcauucucauguccuuccauuucucaggggugcugcaguucacugaggagcagaguguggaaguuacagcauaucugagcuaugggguguguggguuguguuauacccagguucucagggccugcuuuucuaaaacgcuggguaacugcagguguuuguuguuugcuaacuguguguagauaucaucuguguaugccuggcaagaaaggaguuaauaaaugucacgucuauaaucccagcacuuggggaggccaagauggaaggaucucuugaguccaggaguucaagaccagccugggcagcauaaggagacccugucucuauuuaaaaaaaaaaaaauuagcuggguaugguggcacaugccuauaguccaauuuacuuggaagacugaggcugggagguuggcuugagcccaagaguuugaaguugcagugagguaugaucacaccuaugcacuccaacuugggcaacagagugagauccucucucaaaaaaaaaacuuuuuuaaauaaauaaaugcaguagauuggugcuuaucugucuuaugaauauuuguagucuuaugugguccauauagauuccuauccucauuacccagaauaauugaaaaauugguuauauuuaccuccauuagaaguugcaagaauugaauuaaaugucaaguccuauaaaauuguguucaaggcugagcgcagugguucacaccuguaaucccagcacuuuggaaggccaaggcuggcaggucacuugagguuaggaguuugagaccauccugaccaacauggugaaaccccgucucuacuaaaaauacaaaaauuagccaggcaugguggcaggugccuguagugccagcuacuugggaggcugaggcaggagaaucgcuugaacauggaggcagagguuucagugagucaggauugcaccacugcacuccagccugggcaauagagcaagacucugucucaaaaaaaaaaacaaacaaaaaaaccccacaaaaacugucuucaauucuuuuaagacccagcaucugaauaccuuucagagugggggguuuuguaagcuguagaaaauggcugugugaaauagccauauaaauagagugaaauagaauugggaaaauuguccuucaaagugaaugucagguauaucuuuaucucguucuucaaauuaaaauuaaaauguuuaaauugguauugaaaugaauguguaauacaagucacauguaauagagcacacucguauggagaaucauccccgugugaauaucuaagaagguaagcagcuugacuacugaaugcaagugaauuuuaggugaacuugcauuucccaugugugacauguuuguuugguuuuucagaucuuaccaauauauuugaguccuuccugccucaguuauuggccuauccuaaccccauagauccucucaauggugacgcugcagccauguaccuccaccgaccagaagaauacaagcagaaaauuaaagguaagaggauggguaguuuaaccuggagacaaaagaacuuaaaucuguugggcuucagucauuaaaaguccuucuuaaauuacuuaguuccuaauacuuuuucuuaggccuaaaaagagacagcugugggcugaaguagugcucaccaaccucggguggcaguagcaccaguuugcucauccuuugcgauuuagaauccuauuuucccauccuuaaaacaguuuacgugcugaugggauaugaguuucauuuaaaugaagauaaguuugcgacuggccgugguggcucacgccuguaaucccagcacuuugguagcccgaggcaggcggaucacaaggucaggagaucgagaccagccuggccaacauggugaaaccccaucucuacuaaaaauacaaaaauuagccuggugugguggcacgcgccuguagucccagcuacucgggaggcugaggcaagagaaucgccugaaccaggaagcagagguugcagugagccuagacugugccauuguacuccagccugggugacagagcaagauucugucuuuaaaaaagaaaaaaaaucuaaagcuccaccuggguucauuggauuuuccauuuuaccucuguguauguuucagaacuuucauagugaaaagucuagauacaugaagcuccaccaagaagcaaaggaauucaaaguuugugaaauauaccugcugcuuuuaaccaauggcaggcauuaguaucuagccaguuuuucacaugaugggccuaucugcauagcaguccagaauguuugcuuccucaaaauguguggccucucugagguacauuugcaagagguggcaguagaaguaauuuaccagagcuugaaugugcaggucuucacucugaaaugugcagguaugaggcaaacagggacuauucaugaaacaauagcuuuucuucuauuuguuuucuaauucuucuuccaaggucucuauaggguauuguuuggagcuguuguugagauaaagcagaaauaaauuuacuauaauuaauuagaucucaagugcuuugcaaauuaauaucuaauuuauguagcaaaauauauagcuaagcaaacauguauuugaagaaaaaggcagucaguuucagccagauaaagugcuguuaugagacuauauuaaaauuuugacauaggaaucacuuagcaaugucugcaaaccacagauaucuuggagcagaguauauuucucuaguucacauaugcauucugucucaacaauuuagcaguagcccuguuucaguacaugucugcuauagucccauuuacaaaaagaaccgagccuacauuuaucuuagaauggcucacuccagcguacggaccccuagccuucggaaauguucauguuggcuaucauuuugucuuccuuaguaaucucagaaaaucauggccaucagaccugagcucacccccacuuccuacugugccuugauaucuucucccuucccuccugcaucuuuucuuuguuccuaacuauaggaaauaaauaagagacacccuuccucauuucucaaacucacucccaccaccaaucugugaucuuguucccccaaccccccgcccccucccaaugcagucuuccuccuccaccccaucagaggucucccuguuucaggagcagugaucugcuccugugggcucucuuaggagucaugcuguuuauuccuuuucauuuucaaacuucuugcguccucaccuuaaacuccucuaguuuuuuuccccuccucugcuuaaucugugcccucauuucuucccaauccuuuggacucuucucaagucccauuuugcuggaccuuucugcaaguguuacauuuuacccucaucuuucuggaaacuucucauuccauuuccuaaauguggucauucacuuaggacucggucccugggcucccucucuuccuuugucaucccugaggagcuguuucaccucucacagcuucagucaguccccuccagggagaugauuucugaaugugugucuaggccuggccucucucccaagcugcugcuggacauuuccauuuguguggcagucaccaccaacccaacacagcuaacacagucaguguucauauuuaguuggcgcuguauuauaguacauguuugaaaaaguguuuaaauauuggauagcccguagcacugggcaccauuggagcugucuaaagcugucacuucccugcucaaaacccuuugcugggugacaucuuugccugccauucagggcucucugauacugaguggaaucuacaucuuugcccuuacuccuuuuuuuuuuuuuuuuuuuuuuuuuuuuuuuugagacggagucuugcccugucgccuaggcuggagugcaguggugcgaucucggcccacugcagccucugccucccggguucaagugauucuccuuccucagccucccgaguagcugggauuacaggcaugugccaccacauccagcuaguuuuuuguauuuuuguagagaugggguuucaccauguuggccaggcuggucucgaaguccuaaccucaggugauauacccgccuuggccucccaaagugcuggguuuacaggcaugagccgcugcaccuggccauaguucucucuuaagguuguguuuaaacaucccagccacuuacuuucaacaaaacaaagccuuucccuggaguggccucuccuaugccauagcuggcaggacuugggggucaguguggcugggacugccucggccguuuuucguccguaacugcuucccucuggugacacucagcagcuccuuuuaucuuccucuguuuccuccuccucauuggugaccuugcucuuccuuucucucucucaaaggccuuguccuaguaaguacuuaauauacauuuguuuccuugaauacauuaaagagggcugauaguaucaaauucuagugucaaaaaaaggucaauauuuaucuucuacaaaggaagacgcaaaauagucaacccauuagagguuaaaaauaaaauuguuaaaguuugaauaaauauuucucaauuaagguaaauuccuaccuaaucaugggcuacuuuaaucucaucaaaaucauuagcauaaaauuuuguuauaaugaauuugaagggcucuaagucucaagucugcaaaccuuuucuguaaaggaccacauuggccagauguggccuuuaucacacauucuguuuauuauuuuuuaagacaguuuuuaaaauauaaaaacauucuuagcuaggcccugugcuaguuauucaaaucugguaggcccauuuggccauucagcuuaucuuccuauugcagugaguccccgcaacucuauaggaggaaaaacaaagccacaaggguguguuuuuguguggcuugcauuuugaauagguuucugucaugucuuuuccuauuguguggaggcuguucacuugaaaacaguaugcacuuagaguuuuuaggaacaaguuuguuuauucagcaguucuuaaaagccguuucagcagucuuauucagccuaggguuccaccaaggcuguagcagcggaaaucuaccuucagguaaauuauacauggaaaaaccacucagagccgaguggugucuccguauagcagcuuaguccugagcagauugagcgaugguuuuugccagcugcuucaaaaaccugacaggcaggaucuguuuagacuaaaaucgauuccuaaaauaauagaccuggacugaccguaauuauguaacugcagaucuaaaaaugaugaaggauuuccuuauaaauuacuauggaaucaugacugguccuauacuaucugggagaugaaaguaaaaagaaagcguggggcucccauuucccuggucccugaagaguucuuggggugcugcagcacacacauuccccugcaagcugagccugcuguguugcucuucccaauaccccuuuccucagggggcaaaaugcagaaacccugucccaaagaagucucccuaugggauucuccuuagcuguagugaucaugauuacugucaucuuuguccccccugguguucaagguaaguuugaaccuccgcagccuugccagcuuuuuggggucgccaaagcacaugccugcccacucacugcccuuguugucuuucucccaccccgugcagaguacauccagaaauacgccacggaggaggcgcugaaagaacaggaagaggguaccggggacagcucaucggagagcucuaugucugacuuuuccgaagaugaggcccaggauauggaguuguaguagaaaaagcaccugcuuuucagaaagacuauuauuuccuaaccaugagaagcagacuauaauauucauauuuaaacaaagcaauuuuuuuuauuacuaaacaagguuuuuaugaauaauagcauugauauauauauauuauauaucacccuuuagaucuugauuucuuggucauuucucaaccugaggugcauagcauauucccacauuccauuugguagcaauaugcggucugaaugcaugcauucaugaguccauguggccaagucagccugugugcuacugaacugucgaaggaaauagccgcucugauagguagaugugaguaaaaagaacaggaaaaaauugcuucuuuuauugguuuccaaagaaacaaaccaaaccaaccagcucuuggaugugaagauaaaauagugcuuuuuugaaauggagaggaaaaacuuggggaggaagaggccugcugugggggcaucggagccagccauguaagaaucagagcugcuccuuccugugaauccuagguggcccuaugucuucuguggaguuacaguauaaagcagggagcuaauuaagaguauuaaaacuuaaaaccauuuuuugacucugauuuuaaguacauuuuuauaugucaguugcugcccuucacacuaccaggcccugcagccacaguguucuguuggagaaacuuggggaaguguuuucugaaccaguucuuuuucuugggguagagcgugaaauccagaccuguuuuugaaaggacagcacaggaggagaaaagugacugggacgaugcuuccucucauccaaaacacaugcagagucacauccucauccuaguguuuggcaguuugagaccgcuacccugaacuuaagagcuuuaaauaugaggguuguguuucuggggggguuauuuuuuugguguguguguguguguauugugcuuagaaagguugcagauuucaucuucaccuaccaagaggcggccgccuccuuggacaagccgcucauggaccauuagacuugagaagacgacccacguggugacugcaaagcccuggguacuugccuucauguucugguuugguuuucccuuuuucugcugcucuuggcagcagccuggucaucaucugcuugugggagugggaaauggguauuuuagacccaacacagguucuaaauuuaaaacaaauaauaauuggaacaaauaaagguucuuguacccagagugauucuacaugggaaaaacaaaccagcuuuuuucagagagugaccgaauaggaagaagggauucagaaauaugauguaguagaacaugcccugcaggaagaaaauguuuucucuccugcguauguuaagaggaaaucaguuuaaaaugccugcuaaucaaaugucgacucagcuaaccauauguccagguugcugcagaguuucuuucaaaucugaguguugccugcugaacucggaggggaguuuggagaaauuuuagacagcagcucuguguucuuuuuuugccgcagccaauaagauaauagcagaauuagccaauccuaaaaccuucuaaagacgauuuuugagcaucccacugggauuauuuaauuuuucuuuuugacguguguuuuuaguuuagaagugcuguauuccacaagguuuaagucagugagguuggaagauacccuaucuuuuuuauucaaaaagcacaaucaaucuuuuguuugaaaaucuauauaaaguacaacuugcuuuuagcaugauuauuuuccuaaauaaaaagacaaagaauuuacuuacuuuauguuaauuacgggcaugaagcaaaagguuuucuuuaaaaaaaaaaaaaagugcagugauguagggcugugguuaguuaaccguacugaguuauccaucuagcaucuguggcuugcuggaaggguaguauuaacuauuuaacauguaaugguguacuucacucuuaccuagcacgcugucuucucauugcuuugggggagggagggucucucugcuggcacugucuaacuugcuuaccugcugacuuugcaguuugcuugugcuaugacauuuauuguaggugcuauuuaggguaggcuuaaagugcuggguggugauuugaguucaaacaauaaaaaauuguauuuuuucaauauuguauaaacaauaguguucuaauuaccuuaaaaaaaaauaaugaccaguuaagaauugcuuuugaucuugucaaaaaacugaauagaccccaguuucgggaaggugugugagcagugccaugacucugccccuuaccuaaucccacaucucucuaaugauaagacauuggcucgccucugaccagagccccagcaccagagagcggaagaugcagaauugucaaaugaccugcugggggagguuguaggaguuuagcagauuugaguguggcugcagagagagagaguguguguaugugugcacaugugugagagugugagcgagaguguguguguguccaucuaagugugugugaugaaggugggauaaggcuccucuguuagugcuggaagcuccuguaauugccgcauggaucccacugugcccucuuguucugugcaagucuguccugucugggcacuaaccuuggucccaugcauguuuauguucuggguggggcuuugccucuccacugggaaacugacuuuugcuggguugaacagagucccuuaugcuuuuuguccucucccugcgccugggagaggugggaguaggagcccaaacacacagguacagaaagaucuggaagaaggccuggcagugaauccaaggacucugggcccccaacaauagaugguagcguaagucuggagcagcgguguuucaccaccaaaugccuuuccaggcugcccuuccaacacucaggagagcauccagaucccugggcagaggcucuacauucuuggcuuuagaggugguggcagcggcagcaggucagagccacuucuggcgguuucccuccccuuuuuagugcccauaguuuuuggauccucccuugaguuuuaccagcacaagccauucuuugccccuguucacauaacugagcucaagcucuugccaaacaccaacaagcaagaugguugcaaccuggcaacauugaauccaccacccuugggcucccucuggaagccccagcaccggggggcuuuugggcacagggucagugguagccaucuuagacacugacauuuggcuuugucgucaauuucaucacccuccuugagguuacugugcaguuucaaccagcauuuuauccuagugaggucauuaucaggaguugccauaucaucucuccaguaccuaacauuucucauccacuucaaaagcuguucugacugccagcuggcugaucuaagcuccugaggaaugucuccucucaaaggaauuuuucccuccaaaggcccccugaaguccuaguuggcauuggccuggcacaugcuuuauguuaggccucccguugggauggcugagaaucaugaaagacagauccuccgcuagccucugugggucaaguuucuggacaccaagucucugggaacuaguguuugauuuuaaauggcauguggcccuuccuuguuucagugacuuagaaaaguaaaagccauuuaaaaaaguuagcaagauuuuuuaucgacuucccaacugggcuuccagccuuguugaaugaaaucaucuaucucugauugggcgcaacgaacugcauuucuuuggacuucugaauccauguuugugcuuucucuggcccgugaacaccucggcgauucuguuagggaugggaugagugggaggaagcccuuugagaagggggagccggcccugucaugcgcagguuuuccacucaucugaggaagagccagggcucugaauuuagccuaacacucaucuuggcugugggcuugggaagaaauggccauuauuuacagauuguauuugguacauauugugugauacuugaaaagauaaaagggacugccagccccuaacugaaaucugaagcuuuuuaucgcuuauuuuuccucgcccugucuccucccuuccaccuuucuccuugcauugugaugaucuaguaggcacgucugucaacaggacacaugccuccucugacuauaaccucuuaauaguuguguauaaugaaaacuguaaacuuuuuuaaauaaacguguauauaccuuggcaa

SEQ ID NO: 191592 - RNA, 65212 nt, Homo sapiens
uuggucucuggugggaccgggcgcugcccccuuccccugucuccugggucucuggaggagcccaggaaggaggcuccgcugguuccgcugggucaggcgcugacgggaccgggcugcggcaaucguuagcgggucaugucggccgcccagggcugggacaggaaccgccggaggggaggaggcgccgccggcgcugguggcggagguagcggggccggcgggggcagugggggcagcgggggucgggggacuggccagcucaaccgcuucgugcaacucuccgggcggccgcaccugccaggugagucgugggacaggguccugaccgcuugcgggcgggaaggugacugcuaccuuuucuuuuucucccuggcuugcuuuuccuugggaggaggaaaggcaggccccacgcauagcagagggacuggggaucagagaaaagggaaggugucuuugaggucagggagggaacaggagcacagcgaagaaaaguaucugugcucuguugaaagcucugugcugagaguuguguuuucuuuucaaaggagaggccacugucucauugacauuuccaaauguuucgguuacucgauucccaaucucuuccccuuccgcaguuugaucuuguaaaugaaagacauuggcgccuagcugugggaaauuauuucaaaaagggugccaaguuaaggagagaagaaggaaacgcauuccaaggagugauuuuguaaaaacuacacggggcguguguguaagaggcauucugaaacggaagaaaggggugggggaguguuggcuggggaguguaugggaaagagaaccuagaggauuagggaaaacuaguuggauuauuaauauuuuggaauguucagagacaggauaauggugucuagguuuuaaggggagaaagugaagaucaaaaauauacuuagugacacaauuaugcuguguuuacaauauaaaaacaacugagaauuggaaaaauguacccaauacaauuauuugacauuuuggucuacagugcccuagccuugaguucagaugcuuuugaaaacaaaauaaaaucaaguggauauguauguguagacaauuuuaaagagguauguuuguaauugaauauucaaucuaguagaaggaagguagggaauuaaauaaugcagagaacgucaaauaucccacugggcaagcuuauuuuuacuaugaaaagaacuaucaggaaugauguguuaauuauucaucguguuuuuugugaauaauauugauuauauuagugauauauuuguuuagcugaugaguuuugagaacaugaugaauugguuuuuaugaauugugcuuaagacuguaccuuauacuucuagucaaaaauuauuauuugauuaaauugaagaugacaaagggaauuuagcacauuuaaugagacaauugcuuauguucgugaugagguuguugaugugugcuagaaauguacauuaccccauuuauaugcauuaaaucgaggcauuuguaaguagucauauaauauaccagaaguuggguuugagacguuaauaucagacugggcauccuagaauugcuaaauauacgaucuuuaacaugaaaaagaaaaaaggagcaaucuuuuuucuuacucccaauuaauaauaaaaacuuagauuuuuguguauuggcagcuuagaagaugaaucucuuagcaaacacugucaccaguuugcccucuacuaccgcaaucuuuaggucuuugaucacggauuaauuauaccaugggcuucaaguaggcauuccuagguuccuagaaccugcuuggugcacuuccucacuucaaccacgugauggcaguggaagccaugauuucugcuaaggggcuucaguguagagcuauuucugcauucccuuagcacacaagaccaagaacagccauuuauccggagguaaagauaaacgugucuaaacugugaaaauuuguaaagcggggucaucagucucuuuuuucugcuucccuuuucucuugacugacacuucauugcuccuuuacucauucucaaaauugggacacaucugauaccucaauguauuauguaguuugaaauucuuucauaccaauucuuuauucugcuagguauugcauuuuaagccucucccuuuucuugcauuuugauagauuuuaaaagauuuuaggugauggggaggaauaggaugucuaggcuugguugacgggccuuggagauaaaaccuuuuauuuuaaauuuauuuauuuauuuauuuauuuauugagauggagucucacucuguccuccaggcuggagugcagugucgcgaucucggcucacugcaacuccacuuccuaggcucaagcaauucuccugccucagccuccugaguagcugaaauuacaggcgcccaccaccacgccaggcuaguuuuuguauuuuuaguagagacgggauuuuaucauguuggccaggcuggucuugaacuccugaccucaggugauuugccugucucagccucccaaagugcugggauuacaggcgugagccaccucgcccagccaaauuuuuuauuuuuuugaguguacuauagcggcuggucgugguggcucacaucuguaaccccagcacuuugaaaguccaaggugggaggaucacuugagccuaggaguucaaggccagccugggcaacaaagcaagaccacaucucaaguuaaaaauuaaaaaacaacaacaacaacaacaaaaaacuauaguauagcucacugucucucucuuuugaccucuaaauccuauuugucuuuuuuuuuuuuuuuuuuuugagacagagccucacucuguggcccaggcuggagugcaguggcacagucuuggcuuacuguaaccuuugccucccgaacucuagcaauucuccugucucagucugccaaguagcuggauuagaggugcgggccaccacguccggcuaauuuuuuguauuuuugguagagauggguuuuugccauguuggccaggcugggcucgaacuccuggccucaagugauccuuccgccucagccucccgaagugcugggauuacaggcgugagucacagcgcccagccagccccauguuccauuuuucauccuucucuaccaagacuuccaguuacugauacuuagaaccuuuucuuacuuuuuacaucucaacccuccauccagcccccaaugaaaccaaacaaaacaaccuggucuuccuggaguguucucauucucuuucagugauagcuucuuuauccauccaguuaugcaaacuugaaacuuggucauccuccucaauauuuucuucuccguugcacuucagguguaaucauuuaccaaguccguuucuuuuacuccugccauaacuccaauccacggugccaccaucccucacuuaggucuccugcaggagcuuuuuaagcaguauucgugcuucuacucuugcccuucaauucauauagcacaccagucuuuuugcaagcccaaauacauucucaucccugcucacaaccuuuuuauugcucuuaggauaaggcaaaaaucuuuaacauggccucaaaggcacugugucgucugacuccucucuaacucuacaguuaauccuguguuacguucucuuggucauugaucuuuuucugcccccuuggauguaucaugcuuccuccugccccagguccauugcacaagcuuuuccgucauccaagaaccuucuuacuccucauuccauucucuuguuuuaacuucucuuccauuagaucucaguuugaucaaaauguuuuuuuacauggaagccuuccgugacuuucugacuuggucucuucucucuguaacacucauagcaucauguggcucuccuugggcauacuuuaccauuugugugugauuccuugauaugcaugauuugauacucuugagauguaugugcguauacauauacacacauaugcguauauauaugccauauacauauacauauauuuuuaaaauucuaaauuaacgcauuggcauuauauauaacacguuagugucuagugaguuugguuagugugguucaauccucuagccacauugacucuggauagaugguuaaaaucaagguucucucucuuuuuuuuuuuuuuuuucugagauggagucuugcucugucacccaggcuagagugcaguggcgcaaugucacugcaaccucugccucccagguucaagcaguucuccugccucagccuccugaguaguugggauuauaggugcgcgccacugugcuacuuuuuguauuuuuaguagagacgggguuucaucauguuggccaggcuggucucgaacuccugaucuugugauccacccaccuuggccuccuaaaguguugggauuacaggcgugagccaccgugccuggccaaaaucagguucuuuaauguaaaguaguggauuagacucugcauccauugcgacagcacaaacaauaguuugugaaaccuuuuuuuaagcacuugccuuucuccuguuuucugaaguucacuagugauuauguguuugccucauaggccaagaaauuaauagcuuuuuacuccuggauuuuuacuaacucauaauuucuauacacccaguaacgaacagggaauugugcuuuuuguagaauaaguaugcagagagcucaggagcgcgggguucauggggcaauggaauucagguagcuguugugauuuaacugugugaguuugauuaaauaccaugauuagcugggaaaacaguuaaacauuguugcuaacaugggaacuggaaaacugacaaagaaaaagaaggaaaaauguaacaguugguaaagcuggguaaaaauaauacuguagucuuaacuuaaaaauuuuaaguaaguaauguguauaaaauccaaaugauacaaaaaaguauaugguaaaaggcaaguuuuucuucuuccuuugaccccagcuaauugacugccuucccuagaagcaaccaaugauacauuuccuguauauuuuuuccagguucaggggggacgggagggacuuuguggagaugguagcauuccuuuguuuggauggguauuuaagauguuuacaaucuugcuaauacaaauagugauacaaugaauagcccuauacauauauaacuuuugcacaugagagagucuuucuuuaggauaaauuuguagaaguacaguuucugggucaaaggauuuauguuuacugcuuaaauuuugauagauucugucaaauuucaaguuuauguuucccuguuguuguucgagugcugucuuccuuguucuuuugguaacggaguggguuaucaaacguuauuuaaauugucaguuuaauaggaauaguuuucuuaagugucuuuccaauagguagauaaaagagccauuuauuuguuuccuuuaucuauagaucuguuuauauuuuuuguucauuuuucuauugggaugguucauauuguuuauaaaggcgguacccaaccuuuuuggcaccagggaccaguuucguggaagacaauuuuuccauggaccgggauggugggguggaggaguggggggaaugguuucaggaugaaacuguuccaccucaggucaucaggcacuagagacucaaaaggagugcacagccuagaucccuugcaugcacaguucaccguagaguuagcacuccuaugagaaucuaaugcuugaucugacaggaggccaagcucuggcgggaaugcucacucgcccaccacucaccuccugcuauguggccagguuccuaacaggccauggaccgguaccagggguccauggccuggggcuugcggaccccugguuuauaggaacucuguauuuuaaugaaaucaguucuuagccauugacacguugcagauauuuuucacaguuuuucauuugcguuuugacuuuguuuauggucuauuuuuucaucagaaauuaaauguuuuaaauguuuuguugugaaauuuaucagucuuuucagagucuagguuuugugucauaagaaaggccuuuccuauuuuauuauuauuucuaauucaaauuaaauauucuuguguuuucuccagguacuucuguaauuuuauuuuuaaguuaaaugcacuuacccacacaaaauguaaguuaaauaaagugucgaggugggaauccaacuauacuuuucuuccagauggcugcccaguuauggcaguguccuucauuuaguucagcuuugcccugcugauugaaauguugucuauagguguacuuaguuccuacaguuugagguuauuacuggacuuuuauucuguuucauugaucagauuaccuauuuauaccuaaugacucuauuccuugguuaucaucuucccucauucuacuucccagaguuuuccugggaaguuuucuuuguuuauuuuucuauauggcuuagaauuagcuaaccaaguccugcuccucuguccuguuggcauuuuuauugguauuguauuauauuuauagauuaauuuagagauaauugacaucguuuugagguucaaaaacagggucuauauucauuucuuuauguucaagaacaguauauguggccaggcaugggggcucacgccuuuaaucccaacacuuugggaugcugaggcaggcggaucacuugaggccaggagcuugagaccagucugaccaacauggggaaaccccaucucugcuaaaaauauaaaacuuagccguucuugguggcaggugccuguaaucccagcuacucgggaggcugaggcaggagaauuguugaaccugggaggcagagguugcagugagccaagauugugccacugcacuccagccugggugacugaacaagacucugucucaaaaaaaaaaaaaaaaaaaaaaaaaaaaacaguauauguauuuauugucauucaaguauuguuuuguaucuaucaacauuaaaaaguuguuuauuuuuuuauauaggccucacauuucuuauuauguuuauuccuugguguuuaucuuguuuguugcuauuguaaaugggguuucuacuacuuucuuuuuucuuuuucuuucuuuuuuuuuuuuuuuuuugagacggagucuugcucugucgcccaggcuggagugcaguggcaccaucuuggcucacugcaagcuccgccucccggguucacgccauucuccugccucagccucccaaguagcugggacuacaggcaccugcuaccacgcccagcuaauuuuuuguaguuuuaguagagaugggguuucaccauguuagccaggauggucucgaucuccugaccucgugauccaccggccucggccucccaaagugcugagauuacagacgagagccaccgcgcccggccgggguuucuacuuucuuuuauaacuuuuaugugguuguuugaauaugagaaugcuauuaaauuuugaguauuaauuuuauaccuagccacguuaagaauucuaauauuaucuauaauaguuucccaguuguuuuucuagagaauaacagguauagcuaaauaaucauaucauuacugaauaaugauaauuuuaucuucuccuuuucauuuuuuuuucuuuuuuuuuaaauaggccuggcguguuggcucaugccuguaaucccagcacuuuaggaggcugaggcgggcggaucacuugagggcaggaguuugagaccagcuuggccaauauggugaaaccccgucucuacugaaaacacacacaaaaaaauuagccggaugugguagugcaugccuauagucccagcugcucaggaggcugaggcaggagaaucgcuugaacccuggaggcggagguugcagucagcaaagauugcgcuauugcacuucagccugggugacagagcaagacuccgucuccaaaaauaaaaaauaaauaaaaauaaaauaaaauagagauggagucuugcuauguugcccaggcugaucucaaacuccugggcucaagugaucauucugucuuggccucccgggauuacagguauaagccuccgcgcccugccuuccuuuucacucuuuuuuugagacagagucucgcucugucacccaggcuggagugcaaugccgcagucuuggcucacugcaaccucugccucccggguucacgccauucuccugccucagccucccgacuagcugagacgacaggcgcgugccacuacacccggcuaauuuuuuguauuuuuaguagacacgggguuucaccguguuagccaggauggucucgaucuccugaccucgugauccacccuccucggccucccgaaguguugggauuacaggcgugagccaccgcgccuggccccuccuuucacuuuugauacuuauuucuuuauuuuguucaauugauuucgcuaguacuuuccaaaaauacuaaacaauaagauaguaguggagcuuuguccuauuccuuacuucaaucagauauuuuuaaugcuuuccuauuaagauuagaucuggcuuuagauugaagcguacauauuuuaucauguuaaaguauucagcuguuacuguuuuuuuaaaguuuuuguuuuguuuuguuuuuguuuuuuguuuuuuuuugaggcagagucucacucuguugccuaggcuggaguacaguggcucgaucuuggcccucugcaacauccgccuccuggguucaagugauucuccuggcucagccucccggguagcugggauuacaggugcccgccacaacgucuggcuaacuuuuguguuuuugguagagacaggguuucaccauguuggccaggcuggucuugaacucuugaccucaagugauucgcccaccucggccucccaaagugcugggauuacagguaugagucaccaugccaggccuaaaguauuuuuuuuaauaaauacuuuauuuaaaaaauguauuuuauuagaaguaauguugcuaaugccuuuucagcaucuaugggaauuauaauguaauuuuuguccuuugaucuauuauugugguagauuguauuaauggauuuauuguuacugaaccauucuuguguuccugaauuaacuuacuuugucgugguguauuaguauuuuaaacguacugcuggguucuguuugcuaaacuuuacuuagaaauuuugcaucacuccucauaggcguuuucauuuuccuuucuguuuuuuuuauuguguuauuuuuguuuccacuuuuauaaaacuauuucaaagcuugccugccugccugccuuccugccuuccuuccuuccuuccuuuuuccuucccucccucccccuccccuaccuccucccuucccacaccuccucccucccuugcuuccuuacucccuugcucccugccucccuuucucgcuuccuccuucccucccuuccucccuuucuuccucccucccucccuuccucccuuucuuccucccucccucccuuccucccuuucucgcuuccuccuucccucccuuccucccuuucuuccucccucccucccucugucgcccagguuggagugcaguggugcaaucauaguucacugcagccuugaauuccugggcacaugccaaccucuugcuuuagccuccuaaguagcuaggacuacaggcgugcaccaccacacccagcuuauuuuuaauuuuuuuguagagauaaggccuugcuauguugccuaggcugguugcaaacuccuggccuccagucauccucucaccucagccucccaaaguacuaggauuacaggcaugagccacugugccuggcccuuccuuucuuuuucuaugcauuuuuuccccucugugguuaaauggcauugaaguuaaagguuuuguggaauuccccaugaagucauuuggaccuccucuuuuuuaggggguagaagaagcucuuagacaauuauauuguccaauuauaucauacuucuuaguuuuuuugagacagggucucacacuguugcccaggcuggaaugcaguggcacaaucaugggucacugcagccucaaccuccugggcucaagggauccuccuuccuuagccaccugaguagcugggacuacagguguacaccacuacaccuggcuaauuaaaaaaaauuuuuuuuuuguagcaguggggucucaauguugcccaggcuggucuugaauucccaagcucaagcaauccucccaccucggccucccaaagugcugggauuauaggugugagcuaccgugugcagaccaauuauaucauucuuugauaguuggcugcuuacaauuuauaucuuuuggggguagcuuugauaauuuauguuauccuagaaaaucacccaguucauccagauuuucaaaauuauuugugcgaauugaccaagguauucuuuuaugauuacacaauuauuuccuggauuugcaacuacucauuaucauuucuuauuuuguauuaugugaggcuuugcccuuucuuguuuauaaccggcucuuggauuuuuaaaacuuaguuccaauauuuucuuuuuuuauuaauuuguuucuuucaguuuucuuuuuuuuuuuuuuuuugagacggagucucgcucugucacccaggcuggagugcaguggcgugaucuuggcucacugcaaacucugcccucuggguucacgccauucuccugccucagccuccugaguagcugggaauauaggcgcccgccacuacacccggcuaauuuuuuguauuuuuaguagagacgggguuucaccguguuuagccaggauggucucgaucuccugaccuggugauccacccgccucggccucccaaagugcugggauuacaggcgugagccaccgcgccuggccucuuuuauauauuuuuuuuuguuuguuuuuuauuuuugagauggagucucucccuugucacucaggcugcagugcaguggcaugaucuuggcucacugcaaccucugccuccccgguucaagcuauucuccugucucagccuccccaguagcugggauuacaggcgcacgcugccacgccccacuaauuuuuuguauuuuaguagagacaggguuucaccguguugcccaggcugguuuugaacuccugagcucaggcaguccaccugccucggccucccaaagugcugggauuacaggcaugagccacugcacccggcauuuugauaauguuaagucuucuaggucugugaacauguuguauuuccauuuauuuagaucuugaauuuaugucaacaauguuuuggguuuucacaggucauuuauguuuugccugccuuucucaauucugucaucuauuaauaugucccuuacuauguuuucaguagugucugguacuccuuugugcuacuuucaaugaagauuucauuucugcguugguuuuauuuuucccuuccauuucuuuucuguucucuguuuauauuucuuucuauugucugccuuucuagagcuagagucucuuuucuuuucuggacuugagacauuaguuuuuguaaaaccuguugucucccacccccuaccacagccacuauauaaaaggaauacaaacucauuaauuaaaauuuggauaaugggcuggguguaguggcucacaccuauaaucccagcacuuuggaaggccgaggcgggcaaaaagcuuaaguccaggaguuugagaccagcauggguaacauagugagaccuugucuuuacaaaaaauaaacaauauuagccagcugugggggcacaugccuguaaucccagcuaaucccagcuacuugggacgcugaggcaggaggauugucugagcccaaaagguuggggcuguagugagccgagaucaugccacugcacucuagccugggcagcagagugagaugcugccucaaaaaaacccccaaaauuggaaaacguagaaaaauugagacaaggagaaaaucacuuaaagacagcuauaucaacauuuugauauuuuacuuuccuuuuaguucuuuaucaaguguucauuuaauacuguguaaauaauuacuuaucaccuguaggaauuugggauucucuuaaaacuguucuauauuuaaauguuuuacucacaaggcuugcuuauguuuucuguuauuuuauuagguggaaucucuuucuccucaguuuaccauaugaauaacauuuuagguuuuuuccuagcugguggccuauuuuacuucucucuguuacagccaggcuuucagaaagaauagacucuguuguuuauauuuuaauuucuuuuuucucuucagucuuuugcagucucacuucugccuccaucguucuacucaagugcucuuacuaagguaauaacguccuaauugcuaacuccaguagauagcucuuaguuuucauccuacccagcuucucuagaauuugguuuuaacugucuccuaugcuagacccuagaaauacauaauuaacuaaaguuccuguuccuaaagagcucuuauucuuguaucucuugaacuuccuauuaguuuuccuuuaucugccacuuaauauugguauccaagaguauuucuuuuguuuguuuccccuucuuacucuuaguaagauaucauuaauguccugaccaaaccuacaucuaugucuaacccacaucucucucucuggccuguuugccagcagccucuagauguuucuaccaacugacuuaugaguaccucaaauacaacauuuucaaaaaacaauuucaucauuuuuccuggcaaaccuguuacuucauccugugcuccuuauccugacuaauuuaauggcuauaucaucaauuuagugagucaagccagaaaugugggaaucacauuagauuccuuccuuuuacucauuccuuauagaauuggucacaauucgauaaggaauuguguuguugauucuuccuccuuacccucacucuauuugucccuuucuaccucuuuacccuccgcauuuaugucuuucauuuuauauuucagcuauacagaaguauuuucaguuaguugccuuaaauucuuggaacaagguagguugagaggagagauuuuuuaaaaacuuggaauuuccugugcuacacuguuuuuugauucuguacauaccauuucuucuuucuaaagugccauucuccuagucaucuucuuagacccacccauguauacuuuaaucuacauagcauuuuuuccuauucucucuuuuaaucccagcacuuugggaggcugaggcaggagaauugcuugaacccgggagguggagguuguagugagcugagauugcgucacugcacuccagccugggcgacagugagacuccaucucaaaaacaaacaaacccacaaaugacuuaugugugucaagucaaagggacauuuuaaaaucuccaucugccuugaucucccuucauuuuuaaacauccuuuucccuuuuggcuuccugggugucaggucucguuuucuuaugugucuggccucauccuuagucgucuuugucaacucuuucccuucuaccaggacuuuauguaugagaguucucaauucuugguucuguguccccacccuucucuuuucaacuuacuugagguguucucuuccaaaucugugauuuucaauaucuauccauaugccaauaaguuaugccacuuuguaauuucagcccaaaucucuuuugagggccauuuccuugcuuucuccauaucuacaauuacaugcuucauauuucugaagcucagcaagccuaaaacugaauuugugaucuuuauuauaaaauugaaggguaacuauuggguaauuuuaagcacaggagugaugugguaugauuuauuauuuucuaaagcucccucuagcugcugguuggagaauggcuaaugggacacgguaacacagaugcauggaggucauuuagaagacuauagaaguacuuuccuaaaaagauugugguggcuuggacuaggugguauaucagugguuggaagugguugaauaugagauguauuuugaaaguagcauuaauaggauuugcuaugaggugugaaggagagagaagaaucaagaugauugcuaacaaggcuagaugcggugguugacgccuguaaucccagcacuuugggagggaggccaaggugggugaaucacuugaggucaggaguuugaggccagccuggccaacauggcgaaaccccgucucuacuaaaaauaaaaaaucagcugggcgugguggcgcgugccauuagucccagcuacucgggaggcugaggcacaagaauugcuugaacccaggaggcggagguugcagugagucaugauugcaccacagcacuccagucuaggugacagagcgagacucugaaaaaaaaaaaaaaagacuccuaaguuuuugucuugagcaauuggauagaugacagucucaucaaaugugauggaacagaucugaagcagcaggauuguagggggcaaaucaagaguguuguuuuggcaguguuaagcuugagaugccuauuugaccuccaaguaaggauauagaguaaguaaucuuuacauuaaaaaaaaucaaacucaagggagauggugaggcucacaauguuuuuuggaauuauuagcaagccauuggacuggaugaguucaccaaagaauaucuuuagccaggugcgguggcucaugccuguaaucccagcacuuugggaggccgagacgagguugggaguuugagaccagccuggccaacauggugaaaccccgucucuacuaaaaauacaaaaauuagccgggugugguggcgggugccuguaauuccagcuacuagggaggcugaggcaggagaauugcuugaacccaggagguggagguugcagugagccgagaucaugccacugcacuccagcuuggaggacagagcaagacuccaucucagaaaaaaaaaaaaaaaagaauauuuuuaaaaauugggcagaagacuauauaacucuugaaagugagaaggaaaggagaagcaagcaaaggucagugagguaggaggaagaccaagacugcuugguuucauaagagucaagagaaaaacauguuucaagaaggagggagagguuaccuugucgagagcaagguaggauaagguuuuaaaaugguagacucagccgggugcaguggcuccugccuguaaucccagcacuuugggaggcugcgguggguggaucaccugaggucaggaguucgagaccagccuggucaacauggcaaaaccccaucucuacuaaaaauacaaaaaacgccgggcgugguggcuugggccuguagucccagcuacuugggaggcugagacaugagaaucgcuugaacccaggagguggagguugcagugagccgacauugcaccacugcacuccagccugggugacagagugagacucuuucucaaaaaaaaaaaaaaaaaaaaaaauuaacaacaacaauaaaauaaaaugguggacuuuguacuaccauuaguacaguacuauaaguaaucuuacaggguauaguaggccuuugugggcugaguagggacugaccuauuaacuauuuauaacauuggaaaauauauuaagaauuucaaaugacaaauugauguaauuacuuagaauuuugaggugcagccuaauuuuuauuagccuguauauuuuuuaaggcuuuauuuuccccaaauuauuuuuaaggccauucccuuacuuuuuaaaguaagcaguccuugucuuccuccuacuuuauugaccuucuuugcuucuuuccuuuucacuuucaaugguucuauagucuucugcccaauuuuuaagugguuuugaacacucuguaucauuagacuuuuaccaguaucaguauugggcaagcuuguagaacacauaaagguuacgcuuacuuaaaauauguaaguaugauuuccugugauugaaugcauacagcuuuccuccuaaaagucuuuuucauuaauuuuuaaaauggaaaaacauuacauaaacuugguaaaaucaaaucguaugcaagaggagaaagugucccuuucaccugagaccccucguuuugcagucugucucccuagcagugccaucucccuagaguuucuggucugucuuuccagaaauagaauuugcauauaugugcauauagguguauguuaucuuuauauuaaaacagagugcaacaacaaaguauucuuucugcaucugucuuuuuuuuaacuuaaaaauauauuuuggggauuguucuguguuagcacauuuagacuuaucucaugcuucuucauggcugaaaguauuguguugugugaaugugcuguaauuuaccagccacccaauugauggauauuuagcuuguuucugguuucuguuauuuaagaacaaucacugcaauguauaaugauaaauauugcuaauuugccuuuuaauaucuguguuuuuaaaguuuuccucaaguuguagaacuuaaaaacucacacuuauccccuuauuuuacucugcuuucccauucagcuagucuuuuacauccuuauguuuuaucccuauaauaauauuagccagggauuuauauaaacauuuacuuauaacccaguaagggaacagauacuauugcuguccccuuuuuuauaguuaaggaagcugggguacccaggacaaaaccuuguccaaggacauacagcuagcaagggacagagcuaggauuuagacccaggcaaugugguucuaaagucccugcaccaugcugcacuccccucugcuuccuguccuucccaguucuuuuuguuacuaguacuguaauugagguccucacugguguaaacuggacuacacuaaaaauguuuuuuuugcuauuccuagucuuacuuuccugacccauucucuauauuuaaacaagauuaauuuuccuaaugcacagcuaugguuauguugcuugucagaucagaauccuucaguagcuuccugcugcauuuagaauccagcccaaucucaugcucuucccuuuuauauuugcuauauuccaugaauuuguuccaagcuuuaucuaggaugugagcauuaaagcgucauaaggcauaauaagacuagauagugaagugaaauuagaaguauuaugacucacaaaaaaaugagauaagugaucuuuggaguugaaugguguuuuuucuuuugaguuuuuucccuuuuuacccauaguagcuccugccauaugguuucaucaacaaacugucaacucaauuaauuucaaucagauguguaauugaucaaaugcuaaccacaaauauuuuggugucacauaaaacaaauuccuuaaaacacacacauacacacaaaccuaaaacagaaauauggaauuucuuuuuuuuuuuuuuugaaauggagucucgcucuugucacccaggcuggagugcaaugguacaguaucggcucacugcaaccuccaccucccggguucaagcaauucuccugccucagccucccgaguagcugggauuacaggugcucgccaccacgccuggcuaauuuuuguaucuuuaguagugauaggguaucaccauguuggccaggcuggucucgaacuccugaccucaagugauccaccugccucggccucacaaagugcuggaauuacaggugugagccacugugcccggccauauuauacuuuuuaaagcaacuuuuaaaauaucagauauuagauauuaaaaauuugcuaauuagugacuauuauuugcuuuuugcuggauuuaguccaauauaagcuuuuauauccuucagucagcucuagguauuuucuuggaaggcauugcauuugccaagagaaaaugaccugagagaagggaaagugaguucauaaauaaaaguugugucuucaccuuuuuuuuuuuugagacuuagucuggcucuguccccaggcuggggugcaguggugcagucuuggcucacugcaaccucugccuccuggguucaagcaauucuccugccucagccuccugaguagcugggauuacaggcucgcaccaccacgccuggcuaauuuuuguauuuuuaguagagacggggguuuuaccauguuggccaggcuggucucgaacuccugaccucgagugacccaccuuccucagcuucccaaagugcugggauuacaggccugagccaccagucccggccgugucuucacuuucaaaauugaucacuuuucuaguuugguuuuuuguuuuucuuuuucuuucuuucuuucuuucuuuuuuuuuuuuugagacaaucucacucugugacccaaacuggacugcaguggcacaaucucggcucacugcaaccucugccucccagguucaggugauucuccugccucagccucccgaguagcugggauuacagggacccgccaccacacccagcuauuuuaguaaagacaggauuucaccauguuggccaggcuggucuugaacuccugaccucaagugauccaccuuccuuagccucccaaaaugcuggcauuacaggccugagccaucgccccuggccucaauuuauuuuucuaagugaaguuuuacuggagauaaaaaggaaggagaugauacucaauuaagaaaaacaaucucuggcuauaguuaauauuucaagauaggcacauucacaucgauacauauaaaguacaaaugcaggcaagauguuugguaaaucuuacagaaaaaaacccauguacaguaaaaaaaaaacauauauuuuaaaaugaacuuuuaucuuuuaaauuuuuccccuuguccgaaacuucuuagaaucacaaaaaaaauugaaaaagacugcugggcaugguggcucaugucuguaaucucaggaguuugagacuagccuggguaacauggugaaaccccggccccaucucuacaauauaaacaaaaaugacccaggugugauggcacaugccuguugucucccuauugggagacagaagcaggaggauuucuugaguccaggaguucaagaccagcuugggcaacauagcuagacccugugucuacuucucccaugccccgccaaaaaaaagaguauuuauaagugcuaagcauagaguagauacucaguauauaaagguguuuggcauagaguagauaauaaaugucgauuauccuaaauuuaaaagaaagucauuuacuuaacaaguaggucacuguuagcucaauguaugccauugugaaauuuuaaaaagguuccucuuccagguagacauagucccauggguacauuggagaauagagugaaggcuggauuuagccucccuuagacacuuugccuggagcucuugugcaguaagcaaucuguacaacugugcagcgauuccaaauacaguauuaauuugcuucucuuuugaaauucuuuauagauccugaauuguauauaggaguaggacuguaccacauguuguagccaccuaagucagaauucuuggaucauuuucucugauucaauaguuuucauuuuuuuuuuuuugagauggaguuucgcucuuguugcccaggcuggagugcaauggcgcgaucuuggcucaccgcaaccucugccuccuaaguucaagcaauucuccugccucagccucccgaguagcugggauuacaggcaugcaccaccacgccuggcuaauuuuguauuuuuuuuaguagagacggaguuucuccauguugaggcuggucucgaacuccugaccucaggugaucugcccgccuuggccuaauaguucuaauuguuaaauauucauaauuguuuuagagauaucauuuuugaauguaagcuauuccauauuggcaccaucuuuuuuuucuucuuuuugguuuuuauuuaauuuuuauaccuuuuacuuugagaauuguagauugauuuacaguuuuaagaaauaauauuggcugggugcaguggcucacaccugugaucccaccacuugggagaccgaggugggcaaaucauuggagcccaggaguuugagaccagccuggguaacauggugagacccuaucucuacaaaaaauacaaaaauuaggcaggugugguggcacauaccuguagucccagcuacuugagaggcugagguaggaggaucgccugagcccacgagguggagguugcauugagccaagaucaugccacugcacucuugccugggugacagagcaagacucugucuuaaagaaaaaaaaaaaaagagagaagggaaggaaauaauacugagagauccauauacccuuccccaggcaauuucuuggaaugauaacauccuguuacuauuguacaauaacacaacuaggaaauugacauugauacaauccagugaccuuacucagauuucaucaguuuuacacauacucguguguguguguguguguguguguguguaucauauucuguacaauuuuauuucauguuagauucguguggccaccacagucaagauacagaacaguuccaucacaagguucccugguggugcccugauacagccacagccaccuucccuggcaaaccccuagugaccacuaaucuguucucuaaaauuuugucauuucaagaaugcuaugugaguaaaaucauacaguauguaaccuuuugacacuauuuuuuuuuuccuauugguugcauguaucaauaguucaugguuuuaccacagguuuaaccauucauuucgcugaaggacauugggauugcuuccauguuuuggcuauugugaauaaagcuguuaggaacguuuguguacagguuuuuguguggacauaaguuuucauuucucugggguaaauggccaagaauguaauuguugaguuguaugguaaguauauguuuaguuuuguaggaaacugccauacugucucucagaguauguguguaucauuuuacauuccucccagcaaaguauaacucauccaguuccucugcauccuugccaccaugaucaguuuugauaaaacacuuuggcaacuacuguuaacuagucucucucauuuuuagaaaaucagaacugacuucuuacaugugucuucagguucucuagaaugagaccuuugguuacuucuaucaauuugacuuggcaauuggcucuuaaauguuuggaggaauucaccagugaagccagcuaguauucuuaaaucuuuuacacaauaccucaauuuauauuuuuucaucaauaucuauauuagucauuuucuauauccuucaucugaauaagacagauacuuuaauguucuucugguuuuccuucucucagccucccuuccuacccuuauaaauauuccuguugauagcaucugagauuauaguucugaauguuaguaauguuuuuuuccccagucagugcauauuuagacuuaaagguuuuacugguuucucugcuuacccuuuucuugggccuuguuuguuauucuugcauuaauuuuuuaaaaaaacaauccaauuauauaucuuugaguaauuauuucauuagaagucugaaggaagcaaacuuuuugggcccuugcauauaaaaaaauuucuuuauuucacucuccuucuuaagcaagaguuggaguagguauagaauucuaaauguaaaacuauauccaagugucccaggacaauuuguugaaaagacuauuuauuccccacugaauagucuugucacccuugucaaaaaaaucaguugacacuguggauguuaggguuuacuuuuggacucucaauuucauuaauuuaaucuguauguccauccauaugccaguaccacacuuuuugaauacuguaucuuuccagaaaguuuugaaaugaggaaguaugagucuucuuucacuucuuuuucaagauuguuuugauauucuggguuucuugcuuuuuuccaucugaaguauaggauuagcuuguucauuuuggcaaaacaaacaaaaagcuaguugaaauuuuaauauuguucgauucucuuuugugucuuaacuuuuuaauauacuuuucuauaauacuucuucaugcuugggccuuaguuuuaugcucaaucaucuuuaucgugaguccuaguuagccuugcugugaguguuaaaucuguuuauugcagcaggucuccacagauuguggauagggauggaguaagcaaugagaugaaguguacuacuugccaggcuccuucagugugacuguccccucuucugccuggguguuaguauccccacgggguucuaccuucucccucugaucccaguguucacacugauuguucuagcuggagagugacaccuuuguuguuuuugccacuguucccaucugggagcaaauaccucuauucuauaaugcuugacucaaagagguagauggcugggagggguuaaccugcuauguaacuucugugcuacacuccaaucacuuaggcuguaaauguuuaaaaugguuucacuucuuccugcugucuuuuaccuuggggcuuaguugaccccgagaguuggucccuccacuugcccugguccucugcucuugguguguaggacuguggugucuucuuuaguccgauucuaucugcuuuucaucuuccagugauuccucauaguauuaguccacuaagggcauuucuuguuuucuuuuaauuaugucuuuuuuuuuuuaaugacuuuuuuuuguuauuugggagauuuuaggggaaggugagcuugcucacacugugcucagccuaccaucuuaauucagccaaugacuauguuauauuuauagugaaguaaacauaguaagaaagagaaaaaacuaaaaacuagcaaaaaauaaaauauugaugaaguuauugaagaaauuauuauuauuauuauuuuuguggagacagagucuuacucugucgcccaggcuggagugcaguggcgugaucuuggcuuacugcaaccucugccuccugggcucaagcaguucuccugcccucaagcaguucuccugccucagccucccgaguagccaggacuacaggugcaugacaccaugcccagcuaauuuuuuuuguauuuuaguagagaugggguuucaccauguuggccaggcuggucucaaacuccuggccucaggugaucugcccaucucagccucccaaagugcugggaguacaggcaugagccaccacacccggccuauauuuuuguuuugaagagucgaagcuaucacguaggaagguuggcacuuugaauauauaaaaauuaaaacucaaugaauaaaaguucagaccaguaauauauuuauaugaaacuggagaggcauacauuuauuuaaaaauuuaagaaguacauuuguguuggcgucacacuguuauguugcugguuucucuuuuuucugcucuuugggugaaagaauaaaauggguuuugaagucagugccugccuugauugaauaaccuccgcagagucaacaggagucugugcauacagacuuaugcugguugcugagagagagacaugccaaagauguuugauagaagcccugagaagacauaaaaaggguuuuuuauuacaguuuugguguguuaauuauuuuuguuuguuuuuguuuuugagacagagucucacucugucgcccagaguggaauucaguggcacgaucucggcucacugcaaccuccgccucuuggguuccagcaauucuccugucucagccuccugaguagcuggguuuacaggcaccugccaccacgccugacuaauuuuuauauauuuuuaguagagaugggguuuuggcauguuggccaggcuggucucaaacuccuggccucaagugaucugcccgccuuggccucguaaagcgcugggauuacaggugugagccaccacgccaggcccaguuugguaauuuuuaauguuauucccucaguguuacuccaaaguaguuuuuaauauuuuuccauuauaaaaucauauaucguagaauuuauggauaacguaaaagagguaauaaucucaagcccaaucauaaccaguguuaagacuuugguauguuucuuuccaguauuuuuuucuaaucacuuuuuuaaaaaauuaaaauaauacaguauuguuuuucuuccagucuaaaaguaaugccuacucagagagcuuggaaaauaaagaccaucauaaaggggaaaaaacaaaaauaauucauuagaaccauccaaagauaacuacagucaaauacauuaauuugauguaaucuuuccuguauuuuuucugaauauauaaaaauacuuuuuucuuuacuaaaaugguaucauacuuuaauacuauuuuguacauuguauuuuucauuugcaauauauugugaauguuuugucauguuaauaaauaguuuuguauauacucuucagugguauguagaauaugagcauauuuaaguauguuuauuuagcauacuuaaccauccccuaucauuggacauugaaaguguuucuaauuuuuuaccauuauaaauaauaccauaguuaauaucuuuguccauacaucuuuccaugcaucuaugauuguuucuuuaggaauagauuccuagaaguggaauagcugggucaaaggguauguacauuuuaacgcuuuugauacauaaaaaugucaaauuuuaagcuaaucacuuguuauauucugucuuguauugcuaauuguuuugugugucugucuugucucccuaauuagaauguaaacuuaagggcaagggaaguuucuuauauauuuaauguauccuuugacagugugguuuacaauuuuggacucuggagucaucucaacacauacuguauugauuuaaaacaaugguucucuaagauuguugaaugucauaaaccuguacauuaaaaauauauauauacuuauauuuauccauauauguauauuuauaguagauaugggcuugcaaauuuucaguuuuuccacgaaaaaauauuaaaaagaaaaccaacuaccauuuucuuaucagcaucauuucauaaaguaaagaauauuuaacaacaaaaagguucuaaucucugaaaaaggagcaggccuuuaaauggaacauuuuagcuuuuugaaaaacuuauugccuuguccauauuuuucucauuuuauguuggacuggugaaucuucaccuuagccuagcaguggucuguagaccagcauuugagaaucauugauuuaaaagacuuagacuauuaaaagauaaaucauuuugcaaaauaaauaauucuccuuuuccaugagucuguauucucuacaaaauuaagugcaaaugugcaggugaugccauuucauuauacagaaucuguauaucucuauguacaaguucuguaguaagcaaacuagacccugcuaauggacaucugaauauauauuuccaguugccaaaaauaaaaacuguucuuuuucuagggaauuuaagacaggauaaaauaugguguagugggaagaggcaaguuuuuagagucagaaggccucacuugaauccuggcucuggcauuaagucauuuaauuuuccuuuagcuuccuugcuugaaaaauuaugaugauacuaucuucuucaaaguauuuuguuagcuccuguuacagcaauuccuucacaguaacguaauuauuuguuuacacaucugccuuccuuaugagaccaugggcucugaagagcaggaaucauguccuuguuuugcaaucucagguccuagcauagggcuccaggcauagcagaugcuuaauaaaaugauuguugaaucaauacaggauuguugugagaauuauaugagguaauauaugugaaagcucuuuguaaacccuaaacauuaugcaaguguuaauuguuuuuauugucaauaagagcuauauuugggagcgaucaaaacuuugggaaaagagauaauuaccccauaauaguuccauuaauuuaauuagguuuuuauucuauuuuauaagaaaacauauuuuaauugggguuaacauggagguaauuugcuuccugggaaggcagaugagccccuucccucccuucccccauggaagugccaagauauuaaauguuuguuuaauuugguugcuguuuuaaaauuuaauuauaguagagucagcuuauuucguauuuaaagaauggugcccauugcuuuaucuucuuaaccauauaauuaauauaaccuugaagagaacaggagccucuguuauguccaauuaguuucagagcuccauuuugaaauuaacugacuuaaaaaugucaucguuucuaaucuguucauaaagcuccuggugaauuuuugccacaagauggcauuggugauuauugagugcacaugcuauugaaccagaauucccaaaaacggugcacaaaauuguauucuuuuggggguaagaguugaaaaccuucaucacugcuuauauguuaauuuaauuuugacuuccaaaacaggguuaaaugcuacuuuacgucacuuucuuucuguauucaaguauuguuuuguuuccuguuuuucugucuuuauaacuacaguaacuauguauuauuugcaauguguuguaugugucugacuuauugcugauaauugugguaacagguaagaagaaaauacgaugggacccaguuaggaggcgcuucauucaguccugucccaucauaaggaucccuaacagguuuuugagaggugggugauaauuagcaagagaucugugcuucguauggguuaaagggaacuuugaaugaauuuucuaagcucaaaacucugguuuuuaaaaaucaucuaaacagcuaaugaaacaguuggaauaagaaaaaucuagaacuuaauuuuaaaccuguuucuuguuggccacuauugggauuguaauuguaaguuucagggagucagaaucacuuaguguauuauuagaugguagagauaaaucaucucacugauauaaaugguauuccacaguagccauauuagaaagaauuuugagugaauaaucuauaaaauauggaugugggaaagaauuuucuaaauaugauucuaaggaagaaauaaaagauuauguaaugguauaaaauaaaaaaccucuuaugucaaaugucauauauuaaaagauaaaaaagagaauuauuuguuaacaaagggguaauaugaauauauaaagaguucuuauaaaccaauagguuaaaaacaaaugcccacuagaaaaauagguaaaaggauauagaauuaccaguuuguuaaaaagaagugccaauaauuaugaacaaguauuuauuuuuacuauuauuauaaacacaacaauuaaaacaauaagauguuuuuaccuauuagaugagcaaagaccaaaaauaagaauacccaauguuggcaaggguaugggaagauaaagcucauauauugaaggaaguauaaauuuuauacagcuuuucugaaaccaguuugguaauauguauuaaaaaccuuagaaauauucauacccuuugaccuagcaguuuuuacuuuuagaaauguugcauuccuucuacuuuuuauuuuuucuacuaauacauacuccauacugaaaaaagaaaaucucaaaagaggguugaaaacucugguucacacuauuuuucuagauacaacaaauuaucacacaagcauacuuaauguuguaauuuagacuguauuaaauuauuuacaacccaguguaucuaauuuuaacuggaguuuuuuuuuuuuuaaccuaggaaaaaauccugcaacugcuauagauguuucuauaucuaguuccuaaccuauuuuugucaccugagcuccagagcaugcauaaaaucaaccauaaaaugggucaagauaagauccucaagaugguguaccaccuuuuagcaugaguaaauuuuguuaguaagaauuaaggaccaggcuggguggcucauaccuguaaucccagcucuuugggaggccaaggugggcagauugcuugagcccaggaguucaagaccagccaggacaacacggugaaacccugucucuguaaaaaauacaaaaauuagcugggcauggugguacacacuuauagucgcagcuacaugggaggcugagaugggaggaucacuugaacccaggaggcagagguugcagugagccaugauugugccacugcauuccagccugggcgauagagugagacuuuucuccaaaaaaaagaaaaaaaauuagaugauuuuaguauuauccauuguacacacauggccaagcaggcaugucuaauucuauagcauuuuuucuuuuuucuauuuauaaguuagaaugccaauuuaccaauuuccaaugagaaaucuaacuugugcugaauaaagcauaaauuaaacuucauuuuaguuauauuaauauaauuaauuauacauacuaaauauaagcauaauuaaggaauuguuuaggauauauaauucaacauaauaaugauauaaaacacauaaacauaaaaaacaaauagugacauaacagguuguaucuguaugauggggauuuuauuuucuuuuguaugguguuuguuuuucaauuuuuugauuguggagaaaaaagauugcacagguaaguuuuauaccauugguuauuuguaagcccucaauagccucaaucagugguugagaaagguggccccuggcagugcuggaauugaggugggaguuaacucagcaucagcaacaucaggaucacuaguggccuucuuuuaguucucaccuucuuuaaccucuuuguaguguuugaggcuguugacuacuugcccuucuuaaauuuuucucuuuuuuuggguugcuuuacuguauaguucuagauguuuucuuccuaccucuuugauuguucauucuguuuccuucacuagcuucuuucuuccugcucccucaagguggauauuguuccaguguucuguccucuccauuaucuccuuuaguugucucaucaacuuucacaggcuuaagucucuucguuuguucguucguucauucuuucauucuuucaguauuucuugauugcuuccuauguacugugcuagccugaugaucuaaguaauagagaaucagguaaacagacaauuacagaauaauuugaguauaauuauuugugguaaguguucugaugagguagcaugcuaugggagcacacaggagagguaucugacucaacuuggcugaaggagggugacagaggaguggccaugaggaugacaucagaagggaugugcuuaaaggcugaguaggugucagcaaaggaggguuggauccucucaaaccauggggaucaggcagcuugaguaaaggcauuuaggcaaaacaggacaugguguuuuuagagauguagagaaaguucagcacagugggaaagagguggacaaaagaggcuggagagggcccagaucaagugggcaccacccaaguggaguuuucaggaucagauuugguuuuuuagcuagugaagaaauuuaauuaaaggcuaauuaugagauuauuauaguuauuagugugcaaaaugauggagacugaaaugaggguaguuguaauaggaauggagaauaggggccgggcaugguggccuacaccugcaauccagcagagugaaacccugucugucuacauacacacacaugcacgcauguacaauuagccggguguggugggggcaugccuguagucccagcuacuugggaggcugaggcaggaggauugcuugcaacuaagaguucgaggcuacagugagcuauaaucaugccacugcauuccagccugggugaaagagcgaggcccugucucauuaaaaaaaaaaaaaguagagaauugauuugacauauaaggaaguggaagugaaauuagauguagauuuuaggcaaaggauaauaaauucaguuuagucucuccagaacaaccaauaauagcauuaauagcauauccuuuaacacucaguccaagaguauuuccagggaaacuuccuuggcaggccucuccccucuuuguucugauggcacccuccguguaccuaccuauaucauagcacuuauugcacugaauuguaguuguuuacuugucugugccucccauuagacuguaagcucuguaagggcagggacaauaggacagugccuuucauaucuuuacuccaguuuguagcauagugcauguagcagguauaucauauguauuugaccuugaauuaaaguauuguaaaggccacugucagaaaauaggaugggaguaacauuuuauuauguucucaacuucucucugguauuggugacagugaacuaaugaauuguugagaacaugaaaaugcuauuguuuaaugcuucaauagguugugugguuuugcuuguuuguuuguuuuuaacuuaucuauacuuuugaaauagccacuuugaagccugauauuuuggaauucuuuauaucaccucucuugguucagauuguagacaguuucauagggcccauuuucugucacuagauuccucuucacuagguccuacaucuucucuaaaacauauuucuaccaauuaaaauugugguguagugaaaacaguaauggcguaaugaaaacaaugguuuuuauuauaaaauggcagacuuaacauacccauuuacuuuucccuacuucucagaugucauuggaaaugacaaaacagacauaagacaaagaauaaaucauuguaauuaaaaaaaaaaaacaaaaaaaacagaaaagggagacuuugaaacuagauuacuugugucugaauccaggcucugccauuuagcaacuguaugaccuugggcaaguugcuuauucuuuuuuugccucaguugcuucaucuguaaaauuagaaugaugauaauaguaucuacuuccuagaguuacugugaagaucaagagagacaguauguacagagcacuuaggagaguuucuuuacauauagcaaauguugaauuagugcuagcuaucauuauuguuauuguuagaaugccagaaguuuuuagaaauuuuaggguaccagaaaacaauuggaauuauauugauggaggaaccagcacagaauaaaaugcaacccagaauagaugcuccuguugcaugguggaagucagagagugucuuaguagggcucuuuucuuaaacucuaagcauagagguggcaaguauaggaagauggagcaguuuugggggaagguggaauaucagggcagguaaugaaagaauugccuucaaaacaguuacuuccccuacuccuucucucccuucacauaaagcacccuagcaauggcauuaguuccaggauaaagccaugagaacauuucaaggaaaguagaagauuugccuuggggaggauugggcaggcauugcgagcaucgauuaagacuggaggaagaaggccgggugcggcggcucacaccuguaaucccagcacuuagggaggcugaagugggcagaucacgaggucaggagaucgagaccauucuagcuaacacggugaaaccccgucucuacuaaaaauacaaaaaauuagccgggcgugguagcaggcgcuuguagucccagcuacuugggaggcugaggcaggagaauggcaugaacccaggaggcagagcuugcagugagccaagaucaugccacugcacuccagccugggcgacagagugagacucccucuuaaaaaaaaaaaaaaaaaaaaaaaaagacuggaggaagagugcacaaagcagagccuuagcgaauggacuuuuguaguagauggaugaggagaguggaaugagaggagaacaagaagaggagcucuaucaaggauccauaugcauuaaaggacaauacugucaaaauacagccugccaauuuuggcaguaauaaggucaaacugcuuucuuuuucuccacuuguaaagggaagccugucugucagugugccacuuaccugcagagacccacacucagacagaccuuccauuuggguuuuggaggcaaauuaauacaacuguugaggaaacacauguuucuuauaauaacuaaccaauguaguccuucauuuauuaauaugaguaggugauaaaggcucaccauacauuugagggaaacuaagaagagacuaaaauaaacaaaacagcugccuaugguagaaacagagauaaugaacaaguggaguggaacuugaggaaguucuaaucacagaauguaucuuuacagagccaagagugaauuagauccauaaauuuaaaaaaacagcuuccuggcugggcaugguggcucacacuucuaauaccagcacuuugggaggcugagauaggugaaucacuugaggccaggaguucaagaccagccuggccaaacaacauggugaagccccaucucuacuaaaaauacuaaaguuagcuggguaugguggcagccgccuguaauccuagcuauucgugaggcugaggcaugagaaucacuuggaccugggaggcaaagguugcagugagaugagaucgcgccauugcacuccagccuggacaacagagcgagacacugucucaaaaaacaaaacaaaacaaaacaaaaaacgcuuccauggauaaaaaguaaugauuaaugaauuaguuuuauauugaagaauugauugcugaaauuaaaacucaguuggaggguuaaacaauacacuuaagacuaguuacuuuucauaaaaauaaaauagaggaaauuugcagacuauaaagaagaccuacagauagaaaguacaugaggaaaauucauccuuugaggauagaucugagugaucaaguacccauuucacaggaguuacagaaggaaagaucagacaauggaagggagaaaauuuaaaaaucugaguuuuggccaggcacgguggcucacaccuguaaucccagcacuuugagaggccgaggcaggugaaccacgaggccaggauuucaagaccagccuggccaauauggugaaacccugucucugcuaaaaauacaaaaaaauuagccaggcgugguggcaggugccuguaauccccgcuacucgggaggcugaggcggggaauugcuugaauccgggaggcagagguugcagugagcugagaucaugucacugcacuccagccuggguuacagagcaagacucaaaaaaaaaaaaaaaaaaucugaguuuucacguauaaagggcaugccuuucauguauaaaggaccaaacaggaaaaaaugcaaaaacaaaccaacagaaaguaccucccuauacguuacuaaaguacuuacuauuucagagguagaaaacaaguuacauagacucaaaacugaaaaucagacuggcauggauuucucaccugcagcaugguuugcuacaagauaaaugccuucaguguucugaggggaaauuauucucaagacagaauucaguacccggccucacuaauguuuaagugggggggucaaaauaagauuucugaaaguuugugacauaccccauuuugauaaaauuacuugaagauguacucugguaaaaugaaaaauccaggccaggagugguagcuuacaccuguaaucccagcacuuugggaggcugaggcggguggaucacgaggucaggaguuugagaccagucuggccaacaugaugaaauccccccucuacuaaaaauacaaaaauuagccgggcaugguggugggugucuguaaucccagcuacucaggaggcggaggcaggagaaucgcuuaaacccaggaggcggagguugcagugagccaagaucgugcuacugcacuccagccugggcaacagagcaagacuccaucucaaaaaaaaaauuauaagaaaaauaaaauacacuuaccauucauuaaguggaaguggaucaucauaaaggucuucauccuuacugucuuuacauugagaaagcugaggaggaagaggaaaaggaggaguugggcuugcugucucaggaguggcagaggcagaggaaaaucugcauauaaauagacuugugcaguucaaauucauuuuguucaagggucaacuguauaacauucuguaacuaaaauuaaauugagaguuguacuaaagguccuagaauuuuuuguuuuaaaauuuacagguguaguauuaucuacuuacuaaaagaaaaauucaaauaauacagaaauacauagggggaaaagucaggauccuuacugcaagcauauauaacauuucuacaaaucaauuucaaaaaagacaguucaaugagagaauguauguaagaggcuuaagcagguguucuuaaucuguucuugcacugguauaaauaaauaccugagacuggguacuuuauaaagaagagguuuaauugacucacgguucugcaggcuguauaggaagcaugguagcaucugcuucuggagaggccucagaaagcuuuuacucauggcaagaggcagagugggagcaggugucuuacauggcaggagcaggaccaagaggaguugaggggaggugcuaugcacuuuuaaacaaccagaucuugugagaacucaucacuauacaguaccaaggagguauggugcuaaagcauucaugagaacuucguccccgugauccagucaccucccaccaugccccaucuccaacacuggggauuacaauugaacaugagauuugggcggggacacagauccaaaccauaucagcaggcauuucccaaaagaaaaauucaaauggccaauaaacaugaaaaggcgcucacccucauugcaaugagagaaaugaauaguaaaaccacgagagcucuacaaacucacaggaauugcuacauuaaaaagacugacaguggcaauaccaaguauuggcaaggauauggaacaacaggaauucucacaugcugcccuuggauauguaaagugguacaaccauuuugaaaacauuuuggcuuuaccaaacgaaggugaagauuuacauacauuaagauucagaaauuccauguuuacauuuauagccaacagaaaugugagccccugugcacuugcaacaugugcaaaaauguuuguagcaacauuaagaaccacaaauuugaaacaacccaaaaugccucuucacgcaacuuagacuggauaaauaaauugugacauauauucauacaaauaaauaauauuuggcaagggaaaugaacagaccacuucuuuuccccuagaacagggaugaaucucaaaaacauaauugugaauaaaagagcccagaaagaaaauauacuauauuauucuacauauauuauucuauucaaauacacuuuaaaacuaggccaaaauaaacaguauuguuuagagaugcauaccuagguauaauaaagcuauaaaaagacaacagauuuuuaugauugcccuaaaaaucaggaaguaggauacucuagaagugaagggagguuggagggugugaucaagaugggcagucaaaggguuucugggugcuggcuguauucuguuucuugaccugggugaugguuauauguuccuauuuuaauaauuuauuaagcacuuuaugcaguauuguguuucuugagcuggauggugguuacguguucucuuuuuaauaauuuguacauuuaaggccgggcgcgguggcucacgccuguaaucccagcacuuugggaagccaagguggguggaucaccugaguucaggaguuugagaguagccugaccaacauggugaaauccuaccucuacuaaaaauacaaaauuagcugggcaugguggugcaugccuguaauccuggcuacucgggagacugagacaggagaaucgcuugaaccugggaggcggaggcagugagccaagaucacgccguugcacuccagccugggcaacaagagcaaaacuccgucucaaaauaaauaaauaaaauaaauaauaaucuguacauuuauauuuauguaaauucuaaugcaugccauauuuaacaauaaaaggaguuaaauuuaaaaagcaaagauccugccucacaucuucacucaaccaccauuaacaggcgagucuuuccagaugugguucuuucugaagaguguuaaaaaauaaaaguuuguuuuucagcaaguguuagggguaauaagauacagaucuuuguaggggaaaaaagaaagcuuauuucaauaaaaucagaaaagugggaaaauaaagcgagaaagagcgguaaauaaaaaauacauaagauugcagggacaaaucuaaauaagaaaucaagaucaaauggaccuuaucuguggaauguauuuaguuuacuauuuuaauaggcuuaaagaaaaauugugacuuugcuguauuaaauaaaacauuuaauaaaauuugauauuuaauguguucauuuuguuacaaugcauccaguacccuuaugacauauaugcuuuucuguauguuacauuugaauacaaacuuuguguugggcgcacaguggcucaugccuguaaucccagcgcuuugggaggcugaggugggaggaucucuugagcccaagaguuggagaccagccugggcaacacucugucucuaagaaaaaauucaaaaauuagccgggcgugguggcacacaccuguggucccagcuacuugggaggcugagaugagaggauugcuugaaccugggaggucaaggcugcagugagcagugauuacacugcuacguuccagccugggcaauagagcaagacccugucucaaaaauaaauaaacaaauaaaccccacauccauuccugguaagggaaaacauucuuacgcauccagggauaaaagaagauuuauuuuaugacagaauacuauaagaaaccaguaguaaauaucauauaugauguaucauuuauugauaagaaaccaauagcaaacauaauacauaacggcauaaccuuaccaguguccucauuaaaguaaaaaaaacgagacaaagauguccacugucaucuccacuauucaaccuuguucuggaguuuucagccaauacaguagaagaccaggaaaaagaaaaaagaaguacacauauuggaaaagaagaguuaaaguuggcauuaauaacagaugaucugauugucuaccuauaaaauucaagauaauucaugauaacuaauacuagaguucagaaaauuggcuggacaaaauuuaaacuugcaaaaaaccaccuuccuauauauuaacagcaaccaauuacaaaauaaaagagguaucuaguuacaauuguauggaaauuuauaaaguacuuagaaauaaaaaaacaauaaaacaaugaaacuugaugaaauacaaaacuagcugggcgaccaggugccaugguucacgccuguaaucccagcgcuuugggaggccgaggugggcgguucacguggggucaagaauucaagaccagccuggccaacaugacgaaacccagucuuuacuaaaaauacaaaaauuagccgggcgucguggugcacgccuguaaucccagcuacucgggaggcugaggcgggagaauugcucgaacccaggaggcagagguugcagugagccaagaucgcgucacugcacucuagccugggcgacagagugggacuccgucucaaaaaaaaaaaaaaaaaaaaaaaagagccggacgcgguggcccguaccguagucccagcuacucuggaggcugaggguggagaauggcuggaacccgggaggcggagguugcagugaggugagaccgcgccacugcaccccagccugggggacagagcaagacuccgucuccaaacaaaacaaaacaaaaaacccuuccccgggaaaaaaaaaacaaaaaacaaaacaaaaaaaaacuagcugguugaggucgugugcgccuggagucccagcuacuccagacgcugaggugggagaaucgccugaacccggaggcggaaguugcagugagccgaaaucgcgccacuguacaccagccugggcgacagagcgagacuugucucaaaaaaaaagaaaaaagaaacuauacucauggacaucaaaaaagacaagaauaaauggcuagggauuauguuccuuaauggguuaucccagauaaaauccucaagggacuuuuuaaaaauagaauuuuaauugccauagaacuuccgguuuaauugcaaaaauugcaaaaaugguagaaauucuccuguauccuggccgggcacgguggcucacgccuguaaucccagcacugugggaggccgaggcagguggaucgcuuaaacucaggaguuagccgccucaagaccagccugggcaacgagacgaaacgccgucucuaccaaauauccaaaaaaaaaaaaaaaaagcugggcgugguggugcgcgccuguggucccagcacucaucaggaugcugagguggaaggaucgcuugagcucgggagguggagguugcaaugagccaagauugagucauugcacuccagccugggcgacagagcgagaccccaucucaaacaaaaaaaaaaaaaaagaaagaaaagggaaaaaaaugucuccuguauccuuuacccagauuccccaaauguuauuuugucuuuuacuuuauccugcucccucuccucucucccuuccccccuuuauacacaauacgcacauacauauuuuucuguuucaaccauuugaaaauugcagacaugaugucuugcucucucucucuuuuuuugagacaggcugucacccugucgcccaggcuggagugcaacagcgccaucucagcucacugcagccuccgccuccggggucuaagugauucuuccgccucagccuccugaguagcugggacugcaggugugcgccaccacacccuguauuuuuuuaguagggucaggguuucaccguguugaccaggcuggucucgaacuccuaaucucaagugauccacccgccuuggccucccacagugcugggauuacagaugugagccacugagcccagcaggucucuuuuuuuuuuuuuuaauuuuuuaaaauuuaauuuuuuuuagagaugaaguuuuguucugucacccaggcugaagugcaggggugcaaucauagcuuacugcacucaagcgauccuccagcccaccucagccacccacguagcugggacuacaggaaugugccaccaugccuggcuaauuuuuuuuggcagggucgguacagauaggguuucacuauuuugccauaucucuuuaugucuguguaccaaaguguuugcuccugaaaaacagacauucucuuccauaacugcagaaccuguaucaaaauuaggcaucaacacugauuauuaacccuauaaauaauggguacaauuaauacuacuauauaaguuacagaccuuguuucagauuuugccauuauuauuuugccacuauccuaauaauguucuuuuuguuuguuuguuuugagacggagucucacucuguugcccaggcuggagugcaguggugcaaucucagcucauugcaacuuccaccucucaguuucaagcgauucucaugccucagccucccgaguagcugggaucacaggugcccaccaccacgcguggcuaauuuuuguauuuuuaguagagauaggguuucaccauguuagucaggcuggucucaaacuccugaccucaggcaaucugcccgccucagccucccauagugcugggauuacaggcaugacccaccgugcugggccaauaauguucuuuaauagcaguagaaaaucugagauuguguguuacauucuguugucauguaucuuuagccuccuucaguguugaacaguuucucagcguuugucuuuuugacauugauauuuuugaacaguugcaggcuagguauauuguaaaacgucccuuuguuuggguuucuccccauuuucucauaguuacauucagcuuauauauuuuuggcaggacuaccacugaaauaauauugugaucaucucauugcacaugauguugauugauuugucccauuacuggugauguuaauuuugaucaccuggauaagaugcugucuguccaugggacuuuuuauagacuuaacaaacucauucuaaaauucauugcaaaaguaaauggagaaaaauaacuagaaguuuuugggaaaaaguaauacaaaagggaauuuguucuaaauauugaaagauaguucaaagcuauaauaauuaaaacaaugugguaaugagggccaggcauggugacuaacaccuguaaucccagcacuuugggaggcccugugguaggagaugcuuauauaaccaacaaguaauauugugggcuggugugaauggauugcuuuggucugagcaacuugggcucugggaguaguaaaaaguuguaccugccuuuugggggauaugggagagcuaacuggaucaaacuuccuuggcuuuccuugaggcuucuagguccaacagaagaccugucuuuugugguagagguaauuguggccuuuacauuuggaaagaaguaaccaguuaaauugauuaaucauuuaggcuguucgauauuuauaacuaaugaauacuuuuaauaauaaguuuuuuuuuaaaauggccucaccacaaauguucauuagcacaucuguagguggcuacaucuuguaaguaauagacuuacuaagcaguaaauguuauguacuacuuuauuuacaagcuuuuguauuuaagcuucugugauguucuuuuauauauuuacauauuguuuauauauauuuacauucauauauucuuaaagagcaauaaauuuuguguccaaggggauuagaccugaauauugggauuuuccuaauucuacucuagaacaugucgauuuaguauaugguaaagguggcauuucaaauaaguauaggagggguggcuuucuuuaagugguuuggggacaguagccuguuuauuuugggaggaaaaauuagagcccuaccuuauacaacacacaaaaauauaaauucugauguauucgaauucugaauauaaaaaaucaaaacaugaaauuauucgaaacaaaugacaauaucuuaaucauuuuauaauaaugcagaggugaaugaaauauagaacaagggagcuguaaaagacaagauugagagacucaacaccucuguauguuaauagaugccguaaacaaaagacaaggagcaggcuggaagaaauacauauaaaauaaagaauuuggggccaggcaagguggcuuaugccugugaucccagcacuuuggauggcuggggcaggaggaucauuugagcuuagauuagaaguucaagaccagccugggcaacauaaugaugccucaucucuacaaaaaaaauaaaagaaguagcuaggugugguggcucaugccuauagucccaacuacuuuagaugcugaggugagaggaucacuugaggaagagagguugaagcugcagugcgcugugauuaugcuaccacagguaggucucacucagccugagcgacagaguaagacccugucucaaaggaaaaagaaaaaaaaauuacacaauggugagaagacaaccuaauagaucuaaaaaguaggcaaaggagaugauccggcaguuccaaaaagaagaaauacaaaugggccaauaaacaugugaacuaguaaaauaagggaaaugcagauuaaccugacaccaauuuauacccaucagauuggcacaaauuugagaaggcuaaagaaagcaugaagaaguaggcacuggcauaacauugcugggaguagaaauggguccauucuauuuggaaagcaguauggcccuauaacaguauuguaucuauuaaaaauuuuuuguuuuguauuuuuuauuuuuucuauaaaaauuuuaaaugcauauuccuuugaccuagaaauucuaccuccagaaauucucauacauuuguauacaaauauauguagaggaagcuuuguuacaauauuauuuguaguagugaaaacauuggaaacaacuuaaccuucugucacauuaucucagacagcuagcuucuuucugccuuugggcuagaaacugaaacccauuucccugguuaccguaaguuccugcuugcucccuggguaaagagcaaguccuugugacauggaagagaggaugggucccacaucacagggacauaauccuuuagcuucauguucccuucuggauauuaaguguuuaccugugaauacagguucuguuuuaauuuuuugcuuuuacauuucccacugggaguuccugaaucagguaaacgaauucuaugguagauuuuauuagcagcaaguaauuuuuaggaaaaugggauuugcagauggagaaguugggggaggauuuagagagcuacuuuagacccugaaacacaauuucaguuuugucaagguugaggacccuaugcuauauuucaccuaauaaaaauuaaugcuuagucuccguggcauuaauccagacagacaauucccaugguuuauccaaaauggaauggcuuuuuaauauguuagucacucuuggguuauaaauaugagaaagaaaucuguaguuacuggcgagagagaaagaggaguugcauuuuuacucucagcuaugagauuccuugacaggauguuuaauauuuaucaaauauugauuagaugcucuuuacccaaaagugugauuugcagagaucgugaaauuauuaacagaaaccaacaguugggcuggaucagcacugugucagaaauagguaaaccacaaaauuaaaauuuuuccaguacccacauuuaaaaaaguaaaacagacagguaacauuaauuuuauuuaauauuuuuauuuaacccaguauauuaaaaauaucauuucaacauacaaucaauaugaaaacuaauaauuucacauucauuuuuggguacuaagucuuugaaauccagugaguauuuuacauguaaagcacaguucaguuuggaccacccacauuucaagugcucaggagccauauguuauggcucauggcuacugacuugggcugugcaggcuggacuguaagcucccaaggacagagguagucauugccuuaucacuguauccccagcaccuagcacaguacaugguacuuaguacauagccagcauccaauaguaacuuuuuuuuuuuuuuugagacggaguuuugcucuugucacccaggcuggagugcaguggcacgaucuugacucacugcaaccuccaccucccagguucaagcaauucuccugccucagccuuccgaguagcugggauuacaccugccugccaccacaccuggcuaguuuucguauuuuuaguagagacgggguuucaccauguugaccaggcuggucucaaaauccugaccucaggucauccacccgccuuggcuucccaaagugcuuggauuacaggugugagccaccaugccuggcccaauauuuuugaccugagugagugaguagagaaauaugaaaccgucuuuucacagaccccucaacuguguaauccaugugaauuguauuugucacagagauaguuggcaauaaacuuauaacauuacuuucccugcuguacagccauuuagagaaaauguagaauagacugcauuucuuuucauauuugcccaaaagcagcuuuaaaaauuaucuguuggcuucagguaauacagcaaaugacagagauuuuuagaguuccugucugcugaacauagcaacucuguuagauuucuucuuuaaauuugucuugcuaauucuuagaaagaagcauuugugccuugagaagaacauugcauaauccaacacccgugccuuaaaccauguaucuguuaggcauaauaauaccaaaguccacugagaguuagacacuguuuuaaucuucccugucgcuguuuacuuuggccugacguuaaagucaaccaaacuuuuaguaccuguuuuuagguacuaacuguuuuagguguugugggugauacaggauaauuauuauacaugaccuuugcccuugaggagcuuauaaacuguuuggaaaagaaaaacaaacugacaaaaugcauagaaaaaauuaaaugccaaauaaauugauucccguuucauuuaguguuugcugugugcccgaggcuugguuauagaaagguaaauacaaauguauuccuuuucccucaaauagcucacagccuccuagaaaguuaccuguauaagccaauaaacauuucaacaugacaaaucuaacaaaucuuugaagugcaguaauaauaucccaauaugcaaaugaggaagcugagacuaaaugaaggucagugacuugcucaaaguagcaauuagaaagaaccuggauucaaacuuagacauuuauaggagcucuuauuuuuucuuccacaccacacuuucuguuucaagaguccuaaaaagaggaacugaguucuucauuuaagguaaauaguaaauuugccaacugauuauaguuugccugauauucauguauuuacauaguuaaggugugaucuuauuaauuguacauguauacacuaauauaugaguaguaugguacugaacuggaaggguucauuugaugaaaaggguggugugcacuagacuuagguauuuccacaaguagggauugauggguagguagguagacuaggccaagguguaagggaggaacucugggauuuccaagcagagagaaguaugagaaacugacaguaggacaagguuaguaggagaaaagcucuaacauguugggcaggggacuugauacuugaguggugaggaaccaucaaagacuuucaaacacgacuaacagguuggacgugagugacucagugauucacuguuuuuuguugcucucaaucugugcacaauuucagcucugguuuaaaaauauaaccuuagaaagugggauuuugauuuuaaaaaguaaauauagaaggccuguauuagguugguaauaaauguauaacauguuuauuaggugucuagcguuguccuaaauauuaacuuuauacuaguaucuauuaccaacauaaaaaacuacguucaucuuuagggucacaacuauaguagcuucuuauuccauccaauauguauuuaagcaucuuugguucugaaguugggcaaggguuuguauagauugguauaaacauuuuaaggauaacagaaacuacaauaaaguuuuuuguuuuuuguuuuuuuuuacucuaaaauaaccuugaaguaauuuuuaguaaacuaguugagaccgggugcaguagcucguaccuguaaucccaggauguugggaggccaaggcaggcugaucaccugaggucaggaguucaagaccagccugaccaacauggagaaacccugucucuacuaaaaacacaaaauuagccaggcaugguggcgggcaccuauaaucccagcuacuugggaggcugaggcaggacaauugcuugaaccugggaggcagagguugcagugagcugagaucgcgccacugcacuccagccugggugacagagugagacuuggucucaaaaaaaaaaaaaaaaaaaaaguugauauaauuuagacuucaggacacuuucaaauuuaaacuguaggaauagcuuuucuuaguaaagcucuuaauaggaugaaagaugcucucugagauaaauauaaggagauucuuuguuaaccuccauaauauccgggauguuauuuaaagucaaaauuuuacuguaacuccuuaacagccaguuuucauuguaaguguauaauuauaucuuguggaaaaaucauagauuuuguguguguguauuuuuauuuauacaugacucauucauauucgugauuauauuuauuuaguucucuaauauucacaguuuaauuuaguuggccuguguuuuuuucuccucuaaggaaauaagaaaacuuguccuguuagcuuuuggauuauuaaaucuuuccuccuucuuuucuugaaaauuucaaguugucagccauuuucuugaauuugucaugcuuuuuacaguuaucaaaaucugaagguagucauaaaaaauagaaguagagacuagcuccuuaaaaucuuaaguaguauaugugcauaagaaguauuauuaggaaguauauccauguuauaaaucuaaacaaauaagaaguauauccauguuauaaauccuuccugguccccuuuuauggcuaaaaugguuguuaccuaauuuuguuugugcuuuuaaacugguaggacaccuguggaaaacuguccucuucucuccuaggccacagaccuccaccagcacgaaguggacaucguuguguggcagauaauaccaaccuauauguguuuggagguuauaacccagauuaugaugaaucgggagggccugauaaugaagacuauccucucuucagggaacucuggagguaucauuuugcuacaggaguauggcaccagaugggcacagauggcuacaugccccgggaauuggcaucuaugucacgugagugcaagcaguucguaacuccugacuuuaugaaaugucugagaagccagguucaaugucccauauuccucauuaauaauuuauaacacuauaaugugauuucgcccuguggguggauaggcuuuuuacuaggguaauaacaguauggugauuccaaauuauuuggguccugaguuugaauucagcuugucaggugaguuuuagcuuuaauuuccuaacuugcaaaaugggauuaauaauaucuuagaggguucaauauaaaguaucacgcaguagaaggucaacaaauggggcuuaugacgaugacaguuaauagcuguugagcaaaguacaggcauaccucagagauguccuggguuuaguuucaaaccaccaaaauaaagcaagucacacaacauuuuugguuuccuagugcauauaaaguuauguuuacgcuaugcacuagucucuuucaugugcaauagcauuaucucuaaaaaacuacauaccuuaauuaaaaauacuuuauugcuaaaaagugcuaacaaccaucugagccuucagcgaguuguaaucuuuuuugcugguggaggguuuugucuugauguugguggcagcugacuuaucaggguggugguugcugaagguuggggugauuguggcaauuucuuaagacagcauugaaguuugcugcaucaauuggcucuuccuuucacaaaagauuucucuguagcauuuaaugcuguuugauagcauuuuacccagaguagagcuucuuucaaaauuggagucaaguccucucaaacccugccacugcuuaaucaacuaaguuuaagugauauucuaaauccuuucuugucauuucaacaguguucacagcaucuucacuaggaguagauucuaucucaagaaaccacuuucacugagcacagugacucaugccuguaaucccagcacuuugggaggccgaggcaggaggaucgcuggagcccaggaguugaagaccagcuugggcaacauagugagaccuuuucucuacaaaaaauaaaaaaauuaaccaggcaugguguugcacgacuguauucccagcuacuugggaggcugaggugggagaauggcuggagcccaggagguugaggcugcagaagcugugaucaugccacugcauuccagccugggugacagaguaagacccugucucaaaaaaaaaaaaaaaaaaaaaaaaagaaaaagaggccgggcaugguggcucacaccuguaaucccagcacuuugggaggcugaggcgggcggaucaugaggucaggaguuugagacccagccuggccaacauggugaaacccugucucuacaaaaaacacacacacaaaaaaaauuagcugggcaugguggcaggcgccaguaaucccagcuacucaggaggcugaggcaggagaaucccuugaaccugggaagguggggguugcaauaagccaagaucgccccacugcacuccagccugggcaauaagagugagacuccguuucaaaaaaaauaaaaauaaaaaaaauuaaaaaucuguuguuuaguguagccacuuagcuagaucuucuggauaacuugcuguagcuucugcaucagcacuugcugcuucacuuuguacuuuuauguuauggagauggcuucuuuccugaaaccucuugaaccaaccucugcuagcuuccaacauuucuucugcagcuuccuuaccucuccccaccuuuauagaaucgaagagagucagggccuugcucugaauuaggcuuuggccuaaagggaauguuguaguugaucuucuguccagaccacuuaaacuuucugcauaucagcaauaaggcuguuuugcuuccuuaucauucguguguucacuggaguaguacuuuuaauuuccaucaagaacuuuuccuuugcauucacaauucggcuaacuguugaaagaggccuagcuuucgccugccuuugcuuuccacaugccuuccucacuaagcuuagucaauucuagcuuuugauuuaaaguuagauacgguagacucuuccuuucacuucaauacucagaggccauuguaagguuauucacuggccuaauuucaaucuuguugugucucagggaauagggaggccugaggagagggaaaaagaugagggaauggcugauuggugcagucaaaacucucacagcauuuauuaaguucacuguuuuauaugggcgugguucauggcaccucaaaacaguuacaauaguaacaucaaagaucgcugaucagugcuggcgugguggcucaggccuguaaucccagcaauuuaggaggccaaggagggaggaucacuugaggucaggaguucgagaccagccugggcaauguagcaagacccugucucuuaaaaaaaaaaaauuagcugggcauaguggccuguacauauagucccagcuaccuggacaucugaggugggaggaucacuuaagcccaggaguucaaggcugcagugagccauguucaugccacugcacuccagcuaggcaagacagcaagacuccaacucaaaaaaaaaaaaauaaauaaaggcuagguguggugccucaccccuguaaucccagcacuuugggaggcugacauggguggauugcuugagcucaggaguucaagacuagccuggccaacauagcaaaaccccaucucuacaaaaaaauacaaaaguuagccaggcaugguggcacacaccuguagucccagcuacuugggaaauugaggcaggaggaucacuugaguccuggaggucaaggcugcaguaagccgugaucgugucacugaacuccagccugggugacagagcgagacccugccuuucaaacaaacaaacaaaaaaagaguuaaaaaaaaaaaaaaaaaaaaagccagcugggcaugguggcucacgccuguaaucccagcacuuugggaggccaaggcagguggaucaccugaggucaggaguucgagaccagccuggccaauguggugaaaccccgucucuacuaaaaauacaaaaauuagcugggcaugguggugggcaccuguaaucccagcuacuagggaggcugaggcaggagaaucaccugaaccugggagguggagguugcagugagcugagaucacaccacuacacuccagcccgggagacagagcaagacuccgucuuaaaaaaaaaaaaaaaaaaaaagccacugaaauaacauaggagcacuauuuugagagagagaaagagcauauguaugagugaagagaauacguguguacagugugcauguguauguuugugugugugguggcaggaacaaaagagcuacaggaggaagaacaccaaaguuaccugcaggauauugguguguuuuguuuuaaucugguagaggauuaaaaugacagaaaccauaauuguaaauuuagaaaucauucuccuggcaaaaacagaaugucccuuuagucccuuuauucugaguccccuugggucuuugcuaacgcaaagaugauacuucauuuuucucugcuuugcugcaugcuugaacugucuucagcagcagugguauacuggguagacuguaguucauggaacucaauauuauuauacacaguauuuagugaauuccauaaauauguauugaauacgucauauaugccuagcaaugaacuaugugauagagcccauauaguggaauuagaucuuuuucugcagaacuuuguaguauaggcuauguaucccuuaucugaaaugcuugggaccagaaguguuucacauuucaaaauuuuuuuuugaauauuugcauuguacuuagcauaccaaauccaaaacuuugaaauccaacauguuccagugagcauuuccuuuaagcaucauuguuggugcgcaaaaagucuaauucggauuuugaauuagacuucagauuuucagauuuggcacgcucagcuacuaguuagaugucagugguuugagcuaucuuaugagaucauuaaagcagauauguguagcuucucagauauucuggguuuaugugggaacaaauugcagguagccauuugugaacagaacuugugcuucuccuuccucaguugugcugcauggaaacaaccuguuaguauuuggagguacgggcaucccauuuggagagagcaacggcaaugacguccauguguguaaugugaaguauaagagaugggcuuugcucagcugucgggggaagaaacccagucguauauauggacagguaccaaucuguggccagucaugguguauuuguucauauuuuucuagucuggggaugguguuagaauauuuguaauuguuaccauuuuauuuuaauggagaagaguucuuugugguuaguacuugauuuuuuaguucugauaugaaauuauaauuugcaaaucugguuacuugcuguguucuuuucuuuucucuuccuuucuuuucuuuuuuuuucacuuucuguuucuaauucaauuuaggucaggauguagaccuguauggaaguuccuuuaaauguuagaaccccaccuccaccucuacccucaccccccgugagagauugggcuucacuauggucuggguccuggucauuuuuagagugauucuugaguagaugagaaagcacuuggugaagaaacuuuuacauggaucugagcuaaaacauacauuauguagagauuaguuuagguuccagcgcuucaaaccuuaggucugaaaaguuauauccagaaagauagggagcaacccaccauacaucagagacucuuugagaguuuaagcuuaaaacaaccaagcuuugacuucuuucuugacucgcuggcauuaguacugauaaacagcuucugagcuuaacuucaaaggagcacauacuggauaacuuuguugcuuccacaggaggcauuuaaacuuaagaaguggccauaacaauagcugaaacuuucauugaaaaggguccaguggaaaacaucagguuccuugaacugcuaacuaggguuucuacuuagcagauugugguggcuuauuuucauaucugcugcuucuugagagcauuuuucuucagacugcuuauaaagagaagcagcuuucaauggaaaugcuuaugcccaugggcuagaaauuauuugaucagccaggacccuuaagaaucaucuugggagguaggacuuccuuuccaguugaguaaagcuucaccuuucuaaagguguuuuccagguucuuaaaauaaucucuggguucucuaaaaucuuuauucuuuuaagagucugauacauuaaaagauuaaaauacaagagaauuucauaaaaccugauuuggagguaucugguaaguuuacauucuuuaaucaaguguuaacaagucggucuuauucaccuuuccuuguuauccaggcuauggccaucaucaauggcucccuuuaugucuuuggagguacaaccggcuauauuuacagcacagaccugcacaaguuagaucucaauaccagagaguggacacaacugaaaccaaacaaccuauccugugaucuaccagaagagaggugagguucuaggauucaagcauauuuauucuuucgugcuaacauuugaccucuuucagaguguuggcaauaugaagaaaacccuuuggccccaguuagaauaacuaacuggcuguuggauguuagaucucagguaaauaguaaagaaaggucuauaguaaaaaaaguucuucuggugaggaaauaauauuuccuucuaaacuacagaauuuuuuuccaugucauuuccucuuauacuuuagucucucugcauuaggaagauaguaacacuuugaagaagaaaccagugguaacaacuauaaccaaauuucauauuacaggcaaaacaguuaccguccaguuacuuuuugauuucccuuuuuuuaaagaaagggucucacucugucaccuaggcuggaguacagugacauaaucauggcucacugcaaucuugaccuccugggcucaaggcauucucccaucucagcccuccgcccaaguagcugggaauacaggcaugugccaccacgucuggcuaaauuuuuguacagaugaggccgcaccguguugcccaggcugcuucucaaacuccuaggcucaagugaucugccugcccuuggcuucccagaguguugggauuacaggugugagccaccaagcugagccugauuucccuucuuaacuugcauauuagaauucuuuggcucauucucucacagacauaucuucaauacagggcacagggccauccccacagugaugcccagugaauguugauuggauagauggaaggaagcuugcauggauggaugggugaugaaugauagauggauguauggauggauggauggauggauggauggauggauggauggaaaggucauucauuuuaagugcuguguuaaacacucaaacaucgcaugguucucucuaguugccuucuaguagcagaucuauaucuuucacuuuucuuuccuaauagcaguugccucuucauagaauuaaacucacuguggcugggcgcagccuguaaccccagcacuuugggaggcugaggcaggcggaucacgaggucaggaguucgagaccagccuggccaacauggugaaacccugucucugcuaaaaauacaaaaaaaguuagcugggugugguggugggcaccuguaaucccagcuacucgggaggcugaggcaggagaauugcuugaacccgggaggcagagguugcagugagcugagaucacgccauugcgcuccagccugggcgacagagcaagacuccgucucagaaaaaaaaaaaaaaagaauuaaacucacugaaauacuugaagagauuuuuuuuccccuccaguuugaaagcaaagacaguaaaccauuuuuuauuaacucuauuuagaugaauccagugccucuuuguugccucuuuaaacaaaauagcauauaggugcuaaggaagaauuuaucuuaauuguagacuguuaguggacugaucauuguaaaacuaccauaagaggacuuggaaguuggccucuuacuggaaugauuuugauguaguuuauuuuaucagcaacaaggccuucagguaaagaaggaaauagauuaaguuuucaaagcauuuucacaugguugcuuucuuuaagucauuuuauggacauaucauaaauuauuuuagcuuuuagcuagacugccuggaugaaaguucugagguguuuuauguuauauccacaguucuguguaguauaauuuucugcuaaauaaguaucuuaauuugcaaacucauagucuaaggucucuaaauguaggcagaucacuuuuuaaaacuauguaauaauuuccccuuuauacaaaguuaucacaaaagauuauagaaaaaucuacaaaauacaaauuagcaaaaugaagaaaauaaaaauccaagucuaaacucaaagauaaccagguuuaauguuuuggaugauauccuaauagccauuuucuguacauauuaauguaucuauaaauuuuuaaugcaauugauuaaaaaauaaugacacaaaaaaguucucaauacauuaaccaccaucuggugccuacucuguuacugguuguauacuaauccauuuuauguauauucuguaagucauauaaccaauucacuauuguuaaacgccuagguuauuuccaauaacuuauuguuauaaauaaugauguaauaaaaaaccuuauagcuaaaucuuagauaggucauuuuucacuuaauuauaaaugaauuuuauuguaaauuuucagauaccgacaugaaauugcacaugacgggcagaggauuuacaucuugggaggugguacuuccuggacagcauauuccuuaaacaagguauauuuuuuuaaaaagaaaaaaagggagagggagaaggauagaaggaggcuugcgucaaccaagcaagauaauucuguuacuuuggauauuuuaauuuuugagcacauuccucauuaacaccuauuuuguguuggaugcacuuuauaaggucgaacccugugccccaaaaugcuuucaguugacagguguuauuuaucacacacugaaaauacuuuauaaaaauuauccccuuaugcuggaaaaggaaagugacuaaaaggaaggcauaguagcuugaauggagcaacuaauuagaauuggaaccagcauuaucagaaugucacauccgcaucaucaucacugcuguguaucuaaaaagaacaggcuuguuuaggguugcacgucaugaacuugagaaagcugagcucuaaagggcuguuauucauccaucccuguggcauuucuaaaaugucauagucacacaucccaggggaaccuagauuaggcuguagagcuccuggacugcuuggaaccuuaauggucuuuuucaaguuuugucaaaacugaauucccacauucccuuacaaacacuugcuuuuuucuauuauaaaaaugauacaugccccuuguagaaaauguggaaguugcagaacaacauauagaagaaaaucaagcaucacaugcacugcagcuucucauuccaaccuuuuucuucguuuuuuucugugaauuuuaaaaagugggcugggugcgguagcucaugccuguaaucccagcccuuugggaggccgaggcgggcggaucaccugagguugggaguuugagaccagccuggccaacauagugaaaccccaucucuauuaaaaacacaaaaaauuagcugggcguguuggcgggcaccuguagucucagcuacacgggaggcugaggcaggagaauugcuugaaccugggagguagaggcugcagugagccaagaucgcgucacuacacuccagccugggugacagaguaagacuccaucucaaaaaaauauaaaauaaaaauugaaaucauguauguguuuaauuuucaacugccucauuuaauguuuucccuuguauuuggaaagaucagaaaaaaagcaaaagaaaagaaagacuuuucaacuaagaauauauguuuacgcaggcugcugcuguuaaaaguccaguuuucuguauggaaaaucacuguaccuucugcucaguuuugcugugaacugaaaacugcuuuaaaaaacaaagucuauuuuuuaaaaaauccuuuuucaggcuagcuaaaauuacaauuauuuauguauguguauauguucuuuuuuuucuccaagauccaugcauacaaccuugaaacgaaugccugggaggaaauugcaacaaaaccccaugaaaaaauagguaaauuuaaaguauugauuaauuuaucuuuaacaaacauguauuauacuuuuacucauuuuggaaggaaaaaguaauuuuacugaguuauaugucaaguuaaauaccuguugggcugggcgcauugucucacgccuauaaucucagcacuuugggaggccaaggcuugagcccaggaguuugagaccagcccaagcaacauggugagacccugugucuacaaaaaauacaaaaaaauuugcugggccuggugguguacaccuguagucccagcuacuccggaggcugaggugggagaaucaccugagcuugggaaauagaggcuguaguuagccaugauugagccacuacucuccagccugggcaucaaaaugagacccuaucucaaaaagaaagaaaaaucuguugaacugguauuagaaaauacuuguauuccuuagcccaauuauaauuuuuccuuagggcugggcgugguggcucaugccuauaaucccagcacuuuggaaggccgagguggguggauccuuugaggucaggaguucgagacgagccuggccaacauggugaaaccccaucucuacuaaaaauguaaaaauuagcugggcgugguggcauguaccugucaucccagcuacuugggaggcugaggcaggagaauuguuugaaccugggaggcagagauugcagugagccaagaucacgccacggcacuccaaccugggagacagagcaagacucugucaaaaaaauaaauaaauaaaaaacaaaaacaaaaacuaacaaaaaaacacaguaauucuccuuagcgauugagcaaagagacuuuuaauccucuuuguugaauucuuuggcagaaguugggaaauaugggugauauaagaaauuggagccuaaauaaagaucuaccggcuggguaugguggcucaugccuauaaucccagcacuuugggaggcugagcccaggaguucgagaccagccugugcaacauggugaaacccugucuccacuaaaaauacaaaaaauuagcugggugugguggugugcaccuguagucccaguuacugaggaggcugaagugggaggaucauuugagcccaggaggcggaggcugcagugagccaagauugcacugcugcauuccagccugggcaacacagugagacccugucucuaaauuaaauaaauaauaaagaucuaccuaucuccuuguggguaaaagggcuugggaaagccacuagcaacuccuguccuuucccucuuuguuuccggcaccuuagcauuguacuguuaugaugagacuccugauggcuuuugaaauaaggagggaguggaaggacuagucaauguuugcuuaacauguaacaaagggauuguuuugaguuacacguagugugucuuucacuguguuauaucagugugguucccagucuuucuguaaguaauggaacuucuguguuuguguguuuggcaggcuuuccugcagcccgaaggugucacaguuguguucaaauaaaaaaugguaaggauucuaaauaacauuuugcuuccauuucuguaauuguaucuucugaaaaugucuuauuuccuaagauagcccccucaaaagaggcucauaacuuugagaaaagucuauuucuuguaaacuuaaagggaaauucauaguuaugccucugucagcuguuuucauaauguaaacuaguaugguguuuggguuccuucaguuauuagagaacucaaaaaauggugauaaauaagcuuuuauuguagcacuugaucuuucagcaucccacaccucaacagaugucugugguuaugguggcuaauacuaauaaucuugacuguuuauacuguagagaccucagcgaacauuguauuaaaauuguaauaacuccuucagaguguuauuucauaaaguugauucuguucucucucugaugccaaauggaacucuucacucauucuuuggccauauuacaacaaaggcauuguauggcuucagaaagcagcugcagcuacuuuaacuaaaugugauaagugacuccucucuggauaaccuuccugucuuuuaauuuacaacuuauuucaucgucugauauagcucuuaaauuuuuucugggaggaaagcauguauaaaugaguuagauagccuguaugcuuuuagcaacuuaguucagauacaacuaggauuauucugccaucucuaguucagagggauuuuuuauugugcuccugcuuucuggauaagauuuauagauaaugacauugcucacauuucucucugugagaauggaacuguacuuucaguuuuccuugaauccuagccaaaaaaguuuccagugcauuuuauagcuuaaguauuggcuuaaacuuggucuagaccugaguuaagaaauuuauucauuuaauucuuugaggccaagcaccauacaaauagaauucaaccuuaguucuaggcauuucguuugaagguucacauagccuuuguuacaaguuaucuaauuaguuauaacuaacugauuuuaccagaaaacccacaccuuucauuuugggaaaauuauuccuaauaacuguacagaucaaacagagcuucaguuuguccucuucucgccgaagaaagcuuggaagagccucuuuuguguuccuaaacugaacauugcagugaagugaacguuccuccucagguuaaaugucuacauagagacuuuagucucugcgagcagauaaauguauauucuuuccaggacauuauuuaaagaagaguuugcaaacugguggccugcaaauguguuuuguuuggcucauauguguauuaaaauuuuuuuugaggccaggcaugguggcucaugccuguaauccuagcacuuugggaggcugaggcgggagggucacuugagcccaggaguucaagaccagccuggguaauauagugagaccuugucucuuaaaaaaaaaaaaaaauauauauauauauauauauauauauauauacauacuagccaaaacuuaaaaaucaaaauguuucauuuuuaaaaacauaaccagauuuccaacuugccuugaaaaaaauggacgaucuggcaauugccagccuuaagucuguuauaggaccgaacagcuggggcugcauagcugucgccucuuuuagagcaugagcauuucugucuguuuuccugagacuucuguuuguuuaucuucccuagacccccuugcucauuuacuuucugugccuggaaucuguagguauguguuugaauuugguaacuuugacaugaaggcuccuuagaggcuugcauucuuagucccagggaagacccugacauagcaucucaguucuguugagggacaagacaacagcaugagaggcugcacagcagaagucgucugugucauggggcaauccacuucacuggccgcaugucagcuggcugugugaccuacucuaaaacacuccauagcuuuggcucuuuuccuuugugugaucuuggcuuucucuuuucuucauagauguauuuauuugugggggcuauaauggagaggugauccugggagauaucuggaaguugaaucugcagacuuuccaaugggugaagcucccagcuaccaugccagagccaguuuauuuucacugugcagcuguuacaccaguaaguuuuuauuuucauaucuuccuuauguaguuacagaugauaaggaaaucuuuuuagagauauuagcaagaaaaaaagccagauauaggcaaaccuuagaugauuaauaacauauuuuuaaaacuuccuuccaaagcuaggcccuccucuaagaaaagaggagaaaaaucaucacacccaaauuugagagaauaacauaaauguaagagaaaugcuaccuguggcauuccggcccugaccgugaugucaaagguguuuccugggagggcggaauaguuuuacccccuugauaccauauuauugaagauccugcucauuucuugaaggcaaaggccuuuauuuucaucuuuguauucccaguauuuggcaucuuggauacuuaauauagguuuaguuuaauguuaguuaauagugaaauuguuuguuguugaaguaaaaaaaaauucauauauauaggccgggcgcgguggcucaggccuguaaucccagcacuuugggaggccaaggugggcggaucacgaggucaggagauugagaccauccuggcuaacacggaugaaaccccaucucuacuaaaaauacaaaaaaaaauuagccggacgugguggcgcgugccuguauucccagcuacucuggaggcugaagcaggagaauggcgugaacccgggaggcggagagcuugcagugagcugaaauugcgccacugcacuccagccugggcgacagagugagacucugucucaaaaaaaaaaaaaaucauauauauauauauauaguuuuucccuuaguaauucauuaauuauuuaaacccucuugaucuccacaugguauugggaucagugaggaauucuuguuucauuucauuuugauuccaucuacuaugcuuuuuccccacugagucuucagccuuguauguuucucucccguuugaauuuguccucuuuugacuacucauaggcugguugcauguacauucauggaggaguggugaacauccaugaaaacaaacggacugggucauuguuuaagaucuggcuggugguaccuagccugcuggaacuggcaugggagaagcugcuugcggccuucccuaaccuugcaaaccucucccgaacacaacuucugcaccuuggacucacacagggacucaucgaacgcuugaaaugaggauuucuggacuguucauugauacuggaaauguuaauuuaaagagacuccuuuauuuaugggcaguguagaaugugcuacaaagaggauugguuacccugaucaaggccuuauuuagaaaauacaucagaugccuuucuguaaauugguuuuucaguuuauggacaucucacuuucccacgugcuuccuucuuugcuucuguuccuccugacccauuacaugcacauguacucacauacucccucuuccuucucgauggaguuaagggaaagccugaaaguaccuuaauaauguuauuaaucaagacagauuccuuuuuaaaggaauucugaauaguuccaugucauacaauauucuagaaauuaaaacaucaucaacauaaagaaaaaugaaauuaaaaaauuuuuacaucuagcaacagcaacaaccacaaauuuaggggaagcugagaaggcuaaccuugggaaucuugcagguuauacuuaaaccuagauguuuaacuuaguguuuucaagaugugucuaacugaguaguagcugggucugauggcagcagugcuugccaucuuguugcacagauaacucaaaccuacccuuuggcuuugaaggaagguuaagcagcccagcaacucuugguuagugauuucuuucucauccucauggugccagcagugguuagaguugguuugucaaaagacuuacgugugugucguggucgugcucuuuguuguugcucuuagaaauuauggcaccaagaauguuucaaacggaaaaacuugugguggccaaaguucuucauucuggcaguuuugaaacucucuuaugcuuauuaaugguuuuaaauaucucuuugacuucuucauggggaauuguagacccuaaguaugugguguaaaugccauguaacaugaacacaagcucccgagggaggccagagaagagccaggcagagaaaaccugcauccucugggcuuguuaacuuggcuuccacucgggcuguggucuuuggcuaucaucuuggccauuuccuuuugagaacuuguuucuuuucuaaucucugggccagguaccugccauuuucucaggcaguugguccuugauuuuucccuuagcuuguugccuucuuuuccgucugcuuuaaugugcauggugcugugaauaauugucuaguaauuggauacaaggucuuggggguaaagccacaggucauccuuccugaagaaccaaguaucauuuaaaaacuagcaugaggaaggaaugaaacugaguagcauucauuuugugugugugaaauuuuaguucugguuuguuugauuuguuuuuuuuuuaauucuaaaaagaaugacauaaauuuucacucgcuuugccaucuggcugcuaggggagcugagcaagaggcucaccaugcgcauguguaagccgcagguguacucaaggugcugaaggcgugcaaggggcagcgcugguccucccggggccaacucacagcaggagacucgcaugggagaguuggaacacaucuuuccuuuaagugccucuuuuuucaccuagcuuuuaaaguuauucuuuguccuucaucucagaagggaucucuuuagcuuauguguggauuuaaaaugaccuuugagcuacgguuaaaaagcuaccaucugguguucaguucugggaaagagaaaaccguagccuccagacaugcuccugauuucuaggccuuaucauaccauccccucugugauggguugaguucauggagccuguauucugggaagucuuauaauaaccacgcaccugugaacguggguccuuucuggggagugaggaaugugggagagaggcagaaaaaggagcagcuccucuaggggcccauccucccacaucuugccauuaccagucuguguagcacuuaaccuccugccaccacugccaggcuugcuccuccguucucucccagagcaagucagucugagcagcuccauuaguccaaaacagagcuuugcugcaugacuucagccuggccucuggauauuugguggaaauauauucuaaauugaacaagccaggcuguccaggguggcaagaggauuuuugaccuggauuuauacagggaccaaagacugaaugcucagccucugugcuuagacuuucaugguccuuaggauagaagugagucucuagcccugcuacaccagagagcugaagagagauguggucugguuccauccauacuugcuggcauccuuuguuaagccuucugagggcagucuucuuugagguagaccuuggaggccugacaucgaagaccuguguguuuuauuuucauaaaaguauauauccuuggucuaaagugucuucuuuuaauauaacacuaguaaaaaugacaugguaugaccagcacugagugcuauagaaccacacauguguacauguucuggaugccaaaugagacuguguguaaaugacuaaguguagauaacuagaaauuagauaggggucaucaggcguuucgguauaccuauaaccagcacucggaauuccugacacuguuuacuugauuuaggaaaguuuaugccugcugcuucucugccucuuugagguacucccagccgucuuacuacaguccuguaaauuuaagugcaauauauagaaacauauggauauauacagauuauauauaggguguaacuauaaagcagguagacuacuuuuuugcaucuuggggaagugagcucauuacuuuagguucaaauuaugccaagaauuuuagaugugaucagcuggcuuaagccaacucaugucaugauaaagcuggauuuucaaguccauguuuucuuacuccaacucuuagagacucauuguuccuuagguuuguuagaguugagauuuuuuuucucccugucaucuuuguacucucucauguuugcaugucuuacauuuuguugccggagaacaaggaaguccaucuguaaggaguuuccuaaacggagaauuaaaaccuaguauuuaacacuaaccauucuccuauguauauacuaauuuaucugggaauguaauacuuuauuaaaugaagaaaaugaugcuuucuucauuuaauauuuuccacauccuggaaaaacuauaaacugacacagaauagguugaaaucuuaacuggggcuaaacaaaacccuuuccauuggcagaaucuccuuuuuucagggccauaaugacaugauguaaaaauuugcuuuaaaccauucaugcccuuaaauagcuagauuuuaaagcauaauaagcauauuaacauuuuuaagcaaaagauacguuaacagugaccuuugguuauccacaguagcaagaguaaagcacagaucauugaaauccauagauaaucagugaaucaacuuuccuaccaaacaauagauucauuuacauuucuuuuuccucccuauccuuuccuguaagcaccuguuuuuccauggaaugggguuaaugaguagguagaaaaggaaaaggaauaaucaguaggagcugacaaccagugaccauauaagcagcugauugccuguaauuagucaggcugaacaauuagaguugaaugcugaaauuaggaaccacaggugguaauccugaguagauguagcucuucagcgucaucuccugcccugagcuccaggccaucucucuaaccaccaaagaacucuuaguaccuacgggaaggaaaagcugugugcgacacagaggaaacuccauuauuugaacacauuucuuuggcucuugacaaauacuugcuuuuccucuaaucuugcaagagcuauggcucuucuauuuuccaaucacacagcuuggcauguaggaaagguugaaugauccucuaagacuguguuggucuucguauucuguaaaacccauuuuuuuuuuguggucuuacagauguuuagaaaguggcacagguuacugaauugucuaccugccagcauucugauauagcacaaaaagcuauuuuccuuuauuuuuuguauuauuuuuuauuuuucuggcauugagcucuaggguggaugaggguuuaugguccucugaucauaagcuccauucuaaaaacuggucacuguuagcugaaauugcuuugguuccccaaaugccuuggaacuccagacgcacccgcagggccugagguaggcuucauagaguucuaggacuuccgugugcguugccaccagauccugcccagcaauggccuuucccuucuaaggucauuagauucagccaaaagcgaccucuucucuaguccgguguuacgaacagaaguucugaguugugcuacaaaaguaguuccaucuuuuugguguaauuuucauguuuuuaauuugaaaaaaaaaaaaaaaaaaaaacaacuuuuuauaaguuuuuuaagggcccugcuuagucaguguacaggguggagucagaggcaguuuucagaaaaaaacaaaaaacaauuucaccaagcgguaguaauuguuguuuuacuaguuauacauuuagaauauaaaggaggcaucagaaaacacacucucuaaagccacuuccuugugcacagagucugcacagggagagcacaggcaucucccuggaaaagcaccugccaaugacgaauuucauggaagaaccuaggcaagaaaggaagccucuuucugagacacagucucugagaggugagccuagcuuugcucuuccuacaggguaugcuugggccauacacaaugcucgccuuacuuuaaagcuauuuugccacaguccuguuaaauaguguggacguccuuuugcagucuggugugcaugccauaugaucaggacagcuuuuccacuuuacucgguuuccuacaagcaaguaggaaauacagugaauuuacccuaaaauguccaaucuguauuuauguaccuugucaguguuuugcuguugguuuucuaaaacaaucugaucaauaaaucuuauccaaaucaauuugguucaaguuca

SEQ ID NO: 191593 - RNA, 207519 nt, Homo sapiens
  misc_feature (99076)..(199075): n is a, c, g, or u
cggggccggccuuccugcagccucuuccgcucgccggcugcggcgccugggacgguugcggugggucugggcgcugggaagucguccaagaugauuaaaaaauucgacaagaaggacgaggagucugguacgcgcggggcuuccgaggcccacccucagccgcgggacgccccuucccccgcccgccgccaccugcuuucaggccggcggggcugggggcgugggcgccgccgugccagggggccggagcuggagccggccccuccccuccccucgcggcugcccggggccugcccguagccccucccccgggcgccggagccucccuucgggccgcgcgcucccgccccggcgcccgcgcgcgccccguucccgccccucuugcggcgcagccccuccgagccgccuccuccccugcgcgcgggccuccggcgggggccgagggcgugcgcgcgucuccgcguccaggggugcugguagggucggaccccuagugggagcacccuguucccggggcuggggucgacggcacaggguguguguggaggaacguucaggugccugguaccuuaucguuuuccuggggucaccggcucuguccagguccccgggggcaagacugucccgugggacacagcucguugaaugcucagguguccagaagugaccugcgucuugaugcccgucuuugguccagagcaaauggggaagaugccaagcauccucaaaaagaaaaaaauucucaguguuugguagcaucucccacagugugagaggggguuggguuagucaaccuccauggccucuugcaccuuuacgccugcaugauucucugggaaacuucguuucugccucuccuuaaguguuagaaacacauaaaauacugcuuaccuaaggaaaucaaaagcacccuacuacaaucucauuaaucuucguuguuguggaaaugacacauuuuuaacauucauggaaaaagagggcagggaaagaagacacucauuuuggagaggguugcugcgaaagagaagucucagcucuucgaguauggcagugacagagccgggaucaaaaugauuucauucaguucguaugcguauuagccaugauuaucacugugccauccaaguguucacuucccaagcauucaguacccuucucuggaaaguauauaaguuuguguagaacagcuguucaggacauuuuuuuguuuuguuuuauaaauagguaguggcuccaauccuuuccagcaucuggagaagagugcuguuuuacaggagguaugacugggaaguaucuugugcccuuucuuuucuauucuguuuuagaguggugggcagagaaucccugggcugcugugaucacgacaugcaaaacaagaaacguaacagaguuuagggaauauagauuugagggaaaagaaagagggguuacuugucacaggagaauuuggagcuuauagaaaugcaaagacaugaagacugucacagguugggaauuuuaaauguaagaacagguguuuagugcaagguuauugaaaucaguuaucuguauuaaucucauuguauuaguaugauauagauaaguauugugauccuuauuuaacugguauagcccauaaaguugaaguagucaaccuaagggaaugagaaaguauaggauggaaaaucaaggccacguguaauaauuuaucagauaccuuaguaaauugagaacuauagacaauguucuuuggauaccgugauuaaaaauagucuguauuaaaguugauuugcuauaaucugugauagaaaagguagaaaaguagcaauguuuuuuauguuuuuucauaggcucguauauucaaugaaacuccaaucaauccaagaagauguuugcauauucuuacaaagauucuuuacuuacugaaccagguauauuauuuuuauuuuccucagauaaguguguccuggaauagaaauacugaagauucagugaaauacuuucuggaaaguauauuuauuuauuuuaaauucacuuaauuuuaacauauacaacguuugguuaacaaaauaauauguaaaacuugaguacgaggacuaugacauauacagguugaguauaccuucuuugcaaugcucggaaccagaaguguuuuggauuucagauuuuuuuggauuuuggaauauuugcagaauacauacucacugacuauugcuaaucugaguaucugaaauccagaaugcucugaugagugucuccacugaguguuauauuggcacucaaaaaauuucugauuuuggagcauuucagauuuuggauuuugagauuagagauguuuaaccuauacuuccuuuuuauucaugagauccuaaaccagugaugcgcauaguagauucucaauaaauccuuugguuucaauuuaaugaguacuaguuagagcauguuguuuacauguauuuggagaucuucauguuuuucugaaaauacagugcaagaucaggcaaauuccagauauuuucuuuuuuauguguguaaugauguuuuaaagcuuugauuguuaauauucagauuuuauauuuauuaucccuaugcuaccauuacuagcagaauaauucugggcaguagcuuaaccauuuuaugugccuugauguccuuuucucuacauggggauuaugauaauaccuguuacagaguuguaaugacuaaaugagauaauuaguguaaagcacugagaauaguccugaacauacaguaagcauucaggaauaguuuuccuuccaucauucagcaaauauuuauugcguagcugcugugugcugugcacuguuuuagguguuggggauauagcagacaaaccagcaaaaauauuugcgcucaugaaauguagauucugcuugcugcuguuguuauuaauuuuucuuuucuuuuucuuuuuuuuuuuuuugccccagacuuaaaaaaaacucaugaaaugucuagggccuuagaaaauaugauuuuguuucauggauucauauucccucaguaucaguggggaauugguuccaggaccuccauuggauacuaaaguccauagaugcucaagucccucauacaaaugguguaguauuugcauauaaccuacacauauccucccauauauaaguugucucugugauuauaauacuuagacuauaaucucuagauuacaauaccuggugcaauguuagugcuguguaaauaguuguugugcuguauuguuuagggaauaaugacaaaaaaccaucuguacguguucaguacaaacauaguuuuuuuuuuccuugaauauuuucaaucugagccugguugaauccacagauucagaacucaugguuauggagggcugacuauauaugucuauacacauacagacggacacauaaaacauacauauauaccauauaccucaggugguuuacauauggugcuaagauaaccaugguuuccaauuugaauucuaagagaauauauuaucuuuacuuuguuuugugacugaagaccucacucagagauuuaauaaaguuuucuuguuuacaaaugaagacuaagcaacaagcacauagauuuuuuuuauuuuuugagauggagucucgcucuguuaccaggcuggagugcaguggcgcaaucucggcucacuacaaccuccaccucccugguucaagcaauucuccuacuuuagccuccugaguagcugggauuacaggcaugcaccaccacgccuggcuaauuuuuauauuuuuaguagagacgggguuucaccauauuggccaggugggucucaaacuccugaccuuaggugauccgcccaccucagcuucccaaaguccugggauuacaggugugagcuacugugccugaucaucaaacacauaguuuuaaauaaaauauaucuguucacaaacaacauaaucccucugugucagcauaugagaaacauuuaaagcauagucaauuggguuuaacuuuucauagcacacauugugucuaaguuggccaaauccauuguauaaacaaaaguuuugaauagucaaaguugauugagaguaacauguauuuuuauguuggucauuaccucuucaaugaggcaacucauguugaaacauuuaauuaucuugauaaggaaauuaccaagcacagcauaaacacaauuaacuauauaaacagguuugggaacauaaauuuuaucucuuugccuagaacuugguagagcuuuauagaaagauacuuuugaauuucuaugagaguugacauauccauguguuuucugaguuucaaguaaaaaaguaggauguaagguuuuccuguauaacuaaaaagcacacagacuucuggguauucaguaaauaguugugaaagaaagauaaaucucaugcugaugagcaggcuggauacacugauuuaaguaaguauaaacuuauuguacuuugucuuuuauccuaaacugucaguauuuuucaccaaaauuuauucuuauaccuauggcaaauagauugaagacuaguuauauuuuauguggaaucugaagcucugaaaagugauugaguguaacguauuauauaagauugcuuuuagugaagacauuaaauauugaaaugguaauauuugagguaaucuaugauuugagauguuuugaaauacguuaucuaacacuuuuucacugcucagaaaauguaguucccagaucagcauuugcaucacuuguuagaaaugccaaaucucaggccaggcgcaguggcucaagccuguaaucccagcacuuugggaggccgaggcagguggaucacgaggucaggaguucaagaccagccuggccaacauggugaaaccccgucucuacuaaagauaacaaaaaauuaguugggcgugguggugcacaccuguaaucacagcuacuugggaggcugaggcaggagaaucacuugaacccaggagguggagguugcagugagccaagauugcgccauugcacuccaaccugagcaacagggugagacuccgucucaaaaaaaaaaaaaaaaaaaaaaaaaagaaaagaaaugcaaaaucucaggcuuuaccccagagccacugaaucagaaucugcauuuuggcaagaucccaggaugaauugucaugcucauuaaacuguuugaagcucugauccaaagcauguuuuuaggggcuugaaccaauauugagcuacauagcagccccuuaagccuaguuuuuuaauaugaugaaucugguuccugcccuuuugguugguccccuucuugccauuuugcugagauucugaauagauaguuccuuauauuuuaauauuuauuaugcucccaugacauguuaggcauugugcugggcauuauagauaugaucucugcucuuaggcaguguaauaauaauguccuauugugagugcuguaauuuucucccuccuuguaaacuacaauacuucaggaaaauuucagauacuuucuacuaaaaguuuagagaucacuaugccagaacuuuuaagcaugguaugcgauacugaauuauuuuaaauaaggggggauaaauggcuauguggguuuaugcauugaaagccagaaaaauugcagaggcagaauguuuacaaagagauucuuuuuucuugaguucuaaaggauuuuugcagaaauagaaaauccuguguguguauauguacauauauaugaauauacacuuuuuaaaauuuaaaaauuguuuuaaauuuuacuuagggugaacacuuuggaacaacggaagcuacagaagccuucuuugcaaugacgcgauuguuucaaucuaaugauguaagucuuuuuaaauuuuuuuuacgaugaaaaaccuccuuuuauuuauuuuccccagggaacuaagaguguucuaaauuagggagcauugcuugaaauguuuuaaauuauuuaacugcuuauaaaacuuauaaauauucauuauaagacgugaaaauggaagaauuaaaguaugcaguguaaaacuuuucccugcagaucuaccgugaagucauaaagacuguuaauaccuagcuucuggcaugacacugugaagguggacugauaaagaagucagugcacauagcuaccacauuugucaguucuuagucaaguuucuggugggccugggauugcuguuagucagcagugcuggcaguugagaagaagagcuggauguggaguggggaaggggaauaaggaauagaauaaggaaaaagaaaaaugaguacaaacuaaaccugccucucauuaccuuaggccacccugaccuucagaacauacagcugcugcuuuuugucugucuucuaaguguuguguacauuuuucuuuugccuagcucuaaggcagaaccauacagggaagguaauucugggauauguauuuuccagcuuuccauuaacauaaauuggccaaauccugcaguuuuuugguauguauugcauaucaucacaugucacauuuugugucaacccccagaaccucuugagauuugagucuuguuauggaucuaaauaaugagagguuuuaggaguagaucuucaggaagaucagcaguccccuguaaggcagcuguuucaggggaggccauuauauacucuacaggcaaaggaagacuaauuuccucacauaugggauaaaggacugaugcuucuacuagcagaagaugucacagaauuuaggaguucgggguacuuggcuucaucagagucuguccauauaucuucauucuacuuuucagggccccauuccuugccagucaagguccuaacuuuaacauaagauguccugcaagagugugaauucaauuugcauuguaacugagccaccugcaggauauacuuuguagaagucucagcccuguagccacaugauauaaggcuuucuaugaaggcaguuauagauuucuggcccccuuacccagauuugaguagugcuuuuaaaacuccgagcucaucauuuucuuuuccugagaaaagaauuauccaguguaccuagaaacaacuaauuaacccauuauacaacuuauuuuuacuaaaaucuucuauggcauccacuaguuaguuacccaaggcuuugucuucuguagguccuugucugcagaugaugauuuuaaauauuuugccacugcaugcuguggacuacuaguagccccuuuaccauuggaaacuggucauuaauaccuucaaucaaaucagagaagcaacuucagguucauaucuuuaaggacuucuuuuaaccacuuccuguagcagaaauucaggguucagacagggaaacagaaccacuaugaguauuguggaauuagguguuuauuagaggaauuagacuagaaaacuaggcagguugagcugcuggaguaggguucagagggaggcuguuacauaagucauggaaggcuauugccucuuuuguggcuuuguuuuugcagccaggugucuucccaaggcugcuguuacucagagggcuggcaguugggaagaaaagcuggacauguaguggagaaaaggaagcagaguaagaaagaaaaaggaugaggacaaacuuuugaagccuguagcacagagguuuauauuaagaaaagaagauaugaaauugucuucuaggaaauggauuagggaaauguaggauuguucgauaggacuaauagccuguugaaguuagugcuuaugaauuuaaaguauuaccaauguuuuucuccagcuacauggugaauguuuuucuccagcuacagccugcagguuaaagcacugaaggcuuagagauaggauuuaaucaggauugaaguuuugccagguuagugaacagagggagaagcaaaaaaguugagugguuggaacaucgacuguggaaucuucgguuaggagggaagcaagaacgggcugacagggacagcaaaaaguugguagaaccaguggauuguaggucaagagagagugaaagaaguuuggagucaggagugugagugcuugggaaugaaauuagaaagggaugcuguuacugauaggcuguggcagugggugaucauuguagggaggauggcaucauuggagaagaggaggucgaggaaugaagaggucagagguuuagagauaccaucuguauggauauuaaaaucaccaauacuuauuacugggauugcacuggagagacagugaacaagguacugguauuuuuuaaaaauaagggaagugaccugggguuuaauggacaaccagcaaugguagcaggugacauaguauaaaggcauaagcuuccccaccuguaggccuggugguaugaggguuaugggagagaaaacagcugcuauuucagaggguugcaggaggaucccugggagagaaccagguuucaguuaaagaaaaagaugggaacauucagagaagaguuugagaauauaggggauuuugcugaugaaagugucagagaauauaauggcgcugauuagaaggguggaaaauggagucagacgaggugcuguacccagaugcaaggaauaagucugcagguuaugaauaaugaccagaguauuuuaggcuuuuuguagugacugagguaaguagccauguacagcaugaugugauuaguuuuaaugauuccuuaggcaaaaauacggaauugagggagugauuguuuugggacaaagagagguagagauuuugccagaaauacguggagcuccuuccguuaccagcauuccuuuaccagaagguaauuacugucuugaaguugguauucuucuaucguuguuuauauuaauauaugaggauuacauaguuuacaucuguaaucaauacuuugcauuuuugugugucuuaaaauauaaaaauaacaucuucuucuuuugcaauguuguuguuguuguuuuugaguugucgcccaggcugaagugcaguggcgcgaucuuggcucacugcagccuccgccucccggguuugagcgauucuccugccucagccucuggaguagcugggacugugggcacgugccaccaugccugucuaauuuuuguauuuuuaguagagacaggguuucaucauguuggccaggauggucucaauuuccugaccucuuuaucugcccgccuuggccucccaaaguacugggauuauaggccugagccaccacacccagccugcaguguuuauaauuaauacauuuuuaagauuuacuggcuuguuacauguacuucuacuuuauuuacuuucacuacuauauggaauuccaauaugugaauauacaguaauucuauuuauccauucucccauugguagauauaaguuguucccacauuuuaccuauuacaaaugauacugcacauaauguuuauguacacagugagacuuuuucuggaguagauaccuacaaguggaauuucuagauaaugcuuguuuguucguuuuuuuuuuuuuugagacggagucuugcucugucgcccaggcuggagugcaauggcaugaucucggcucacugcaaccuuugccucccagguucacgccauucuccugccucagccuccugaguagcugggacuacaggcacccgccaccacaccuggauaauuuuuuguauuuuuaguagagacgggguuucacuguguuagccaggauggucucgaucugcugaccuugugauccgcccgucucagccucccaaagugcugggauugcaggcguaagcuaccgcgcccggccuaagcauauuuucauguacuuauuugccaucuguauaucugcuuugaugaagugucuguuaaaauuuguuaccacuuaaaaaaaucagguugucggcugggcccgguggcucacgccuguaaucucagcacuuuaggaggcugaggugggcagaucaugaggucaggaguuuuagaccagccuggucaacauagugaaacccugucucuacuaaaaauacaaaaaauuagcugggugugcuggcaggcaccuguaaucccagcuacuugggaggcugaggugggagaaucacuugaacccaggagggggagauugcagugagcugagaucgugccacugcacuccagcccagguaacagugcaagacuccgugucaaaaaaaaaaaaaucagguugucaucuuacugaguuauaaguuucuuuauguauucuggauagaaguccuuuaucagacagauguuuuguaaauauuuccucccagucuguggcuugccuuuucauuuacuggacuauuauuuuuuuuuuaaguguaguuuuacaugcgguaaaauucauccuuuuuaggguaucauucuaugagcuuugacaaacacauauagugguguuaucaccaccacaauugagguuuagaacauuuccaucuccucaaaaaguucccccgugucucuuuaucaucuguuucuccuugccucccucagccccuggcaaucuaucuccuuucuguccuuauaaauuugccuuuuccaggaagucauaugaaugauaucauacuguaugaagccuuuuuugaguuucuuuucaguuacuuagcauaaugcaugugagauucauccauauuauuguuuguaucaguaguuuauuuuuauuuugucaucguauuccauugaauggauguaccucuguuuaucuguuugccaguugaaggauauuuggcuuguuaccaguuuuuggugauuauaaacaacauugcuauaaacauucauguuuugauuuuuggaugaacauacauuuuuauuucuuuuggauaaaugccugggagugggauugcugggccauauguagguaugguauguuuaacuuuguaagaaacuaccaacccauuuuucuaaaauauuuguaaucauucccgccaucacuguaugagagcagcaguuugcucugcauucuggccagcacuuuguauugucguuuuuauuuuuguuuuuaauuuuagcuauucugauagguguauaaugguaucccuuugugacuuaaauuugcauuuuuccaaugacugaugaucucaaacaucuuuucauuuguauuuuuaccuuccguauaucuucuguuggugaaggauuuguuaauaucuuuugcccauuaaaaaaauuggauuguuuauuuucuuauuauugaguuuuaagaggucuuuaugcauucuggauacaaauccuuuaucagauauguuucacaauuauugucucucaguauauggcuuauguuuuuauuuuguuaaagucuuucaaagggcagaaguuuuaaauuuugaugaaguccaguuuaucaaauuuuuuucuguuacaggugaugcuuuuuaugucauaucauagaaaucuuuccuuaaccgaaggggacaacgauuuucuccugugcuuuuuuucuggguguuuguaguuuuauaucaauuaccuuaugauccauuucauauugauuuuuguauaugguauaaaguaaugguugguuucuuuucaccucuuuucucuuccuccauccacugccucuuccuuuucuuccuucuucauuuucucaacacaugguucuggaacaauugaauauccauauggaaggagaaaggggaggagggggaggagaugaugaagaugauugaguuacauuggcacguuggcacauuauuuugucucauugaccuauaugucuguucuuacuuuagcucuaugcugucuugauuaacuauagguuuaaaaucuauaguaaguuuuauagugcaaaucuuucuauuuuucaaaauuguuuugguucuuuugggcccuuugcauuuccauauggauuuuaaauaucuauauuauauauagauaauauagaaauauguagauaucuagaaauagacaagguuauauuauauauaauauaaucuuuuuauauagauauaaaaaugcugcuggaacuuugguggggcuugcauuaaaucuaaagagcaauuuuaggagaauggacauuauagcacuauugaguuuucugcuucacaaacaugguauauaucccuuuauucaagucucucuaacuucugucugcaguauuuuauaguuuucaguguacaagucuugcacauauuuugugaaauuuaccccuaaaguagauaguauguuuugaugcuuuuguauuuguauuguuuauugguagucucuagaauuaaaugaacuuuuauauauugaccuuuuucuugugaucuccuuaaauguuuguuagaguucacuauugcagcugucuucuuagugggaaggcuuuucgggguuaauuaacuucauuuaaaaaauguauauaugaugccauucagguuauuugucuucuugaguguacucugguaguuuguaucuuucaaggaauuucaguuaaauuguugaacuuggcauaaagcucuucauaauauuccuccauucuuuuaaugucugcagaauccuuaguggugucucuuccuucauucugauauugguaaauuguauuuucucucuuuuauuucuaggaagcuugucuagggauuuauaaacuuuauugaucuugucauagaaccagcuuucuguuucauugauuuuuuuaaaaauuaauuauuuuucucuuccaaacuaauugugcgaaaagaaaaaaaaaagcuaaaaaaucaaaccaaaagaaggggaaaaaaagaggaagagaaacauagaucaaauaggacaaacauaaaucuuauaaugaccugguagauauagacccaaauauaucauuauccacauuaaauguaaaugaagagcacaaagaucauuuacaaaaaguugauuguauauugagccauaaagcaagacacaacacauuucaaaggauugaaaucauauagacuguguucuuuauuuacaaugggauaguguuggaaauuaauaaaaaaagaauaacuagauaaauugccauuuauuuugauaguaagaacauuuuucuguuuuguuuacagccaugauaaaguaaauggacuggauuuacccugcuacuauaaauaccuagaaaaucaaacaaaauuuaugacauaacaguuuucagauauuggauaauaggcaucccaggacugugaucugaagaagggaaacuaggucagcccuaggauuguacuagaucauggcccagaaacagauuacaggccuaguucucucucagaguugagaaaacgaauggagguugggagccaggaaagcucgaauuuaugaagcagaauaccaaagaagaaggagcuggagagaaaaaagaggggcggggagagaaggaaggaggagagggagggauuccaugaucuguugaggacuaucccuggagucuuugguuaaguaaaaacugaucuguguguguaaaaaaggaaacuacucaaagcuaaggaaagaauccgaaaaacacagaacucagaauaguuuguauucccaccagugagaguggaaagaccuucuauugcauaagacaucugguauaguucucaaaaggaaaccauucauaaguaauuauuaccuaaguaaugggaauauacuauaaccuuacacuaaaacuuuaaaaagccuguaaguaagccucaaagugaaaaaaaaacaaacaaacuaguccugguuaaccuucccucacgacagaauagaguucaauacuauuuaagaucauacaccaaaauaaacuucacaaugugcagcaucuaauaaaugaucagauaugcaaauaaacaggaaauauuaucuauaaacaggagaaaaauggaucagcagacacaaacccagaaaugguaaaggugauggaaugagcagaugaugucauuaaaacaacuauuaacaugaucuauaugcuuaaguuguaaagaaaggcauaacaagaauaaagcauaaaauaggagagauacaaagagauccaaauacacuucccaaaaauuaaaaaaaaagaaaagaaauauauaaaaugaaaacuacacugcaugggguuaauagcaaauuagagauguaggacaaacaaacaaacaaacaaaaaaacccagggucauugaagacagcaguagaaguccaaaauaaagcagagaggaaaaaaagacagaguagaaauaaacagagcaucagcaaccugugggguaauacuuuggaaguuuuuuuauuguuuauauucaaaauugcaauggguuuuugacuuaucaaaaucaaauacucaucuuuguguuuucccuacucaugggaaauucgagagucuuaggauacucugauuccuuauacguauaugaguauaucaacauauguguauauauacauacacacgugcacauuuacauuaauauauucuaugccaucauuuucuugugagucuuguuugcucauugugacuuacuccugucuuuagcacuuuuuaaaaacucuucauuccuugcucuauuucugaguuacucuggaaugauuuuccuugugcuugaagaauauaccuuuuagaaccucauuuugguagauguuagauacuauauuccaugccaguaagauccuucuguggcugugaauguuugguugucuucauuucuagcaucugugaauuucucuuuauuuuguccuuggcuacacauuuaaaauuuuuguucugauuuuauucagcauuucuguguauuuguuuaugcaguauguuuuagugguuaagagcacauuuuuggccaacauuuuguguuguuugucuuuugaauuuucaccauuuuggugggugugagguaguuucugaaacgugguuuuaauuuuucauuggauaaguaauuuucauuucccugaugacuaauaauguugagcccccauuuuuuguguuuuaaugaaauuuuuuucguaucucuaguuuucuucugcuucucacagaacuuuuuuuuucuuuaaauuggggugggguguuccugaaauuuugauucuuauuuuuuguuuucuucucauaguagcuuugaucugccccaugugugugccuauacuggcuuucuguguguguuuuuuuucuguuuuuaaucaccacgaggauccucacucucuuuucuuuccuuaauggguucaguaguaucaagguuuucuccauagcuuggacucuggagcugcgucugauguauuuggguuucucuacuuaaaagaaauuugagguuacucaguaagggaugaggcuggacagacuagaggaaccuggugucuggcugcugcccauuuauccauaguguaugaauaaaucagagauccaguugagucggggagaguagguggagcauuguuagcuuaguacuuacuuggauccagguauucaucuagaaaucucauuuaggguucaggaggaaacauugguauacacugaacugaggaaagugcagaguuugcacauuuuccaggaaugagccuuuaauuaauacuguacgccgucucuacuaaaaauacaaaaauuagccaggugugguggugagugccuguaauuccagcuacccaggaggcugcggcaggagaauugcuugaaccccggaggcggagguuguggugagccacgauugcgccauugcacuccagccuaggcaacagagcguaacucugucucaaaaaaacaaaacaagacaaaacaaaaaaccuuugucuuuggacucaagcuaucauagucuaaguuuguaucucucaguagaaagauccauauaauugaauuuuuaaguuuuuaccuauugugucaaugcaucaguuguguuuaggaaauauuaguauucugaauaguuucucacccagauauuaauuuuuuuuuuugguagaugagacucuuuuaaagaauaucuuucuaaaauauauaucuacuugggguccucacuucaaauaauuuaaaaaaccauuuccuaaucaauaaucuguuaccuuuuauaaaugauuuuucagcaaacauugaggagaaugugcuaccuuaccaucaaagaaauggcuaccaucucugaggaugugauaauugucacaagcagguauguaaauggucaaaaucuaggaugagauacuuauauauuugcuguuugcuuucuguugauuucauuuuuugaccauaagaaagccaauaggaauuuaaaagaauauaauaucuuaaagcauucuuuucuaaaaugaaguuuucaucaugugaaagccauccuuaucugauaaagcaaaggaagaaguuacaaaagauaauacugauagauuugagugcaucaaaauuuucauaaaaauggauaaaacuaaaaaguaaaagauaacgugcacugaaauaaaauauuuacaacaaauacaucaaaggcuagcaucuguaauauauaaagaacuuuuaaaaagaaacaagugauaauucaucaaauaaccaauauaaaggaucuaaacgucuuuagauagucguucucacuaguaaccaaaaaacauaaauuaaaaauucaagaaugagguauaauauuuuuuacucaucaaaauggcaaaaaagcaaacaggcagcauucaguacuuguguaagggagacauacucuuguacaaaggagacagaguaauaaauugauucaauuuuucuagaaaguaauuuagcaacauuuauugaauaauugaaaggcuuuaucccuuugaccuaguaaggccacaucuguggaacuauccuuggaaaauaaucagacauaacacagaaaaacuuauauauauugauguuuguugcaacaccauuuacaguagaaaaaaggacaaacaacuuacgugucuaccauugauaaaauuauuuaauuaaccauaucaucauauuauaaaauauuuuaaaauuuggagauauuuuugaaacaucugauauaaauaagucuucauaaagugcuaaauggggguuggagucaaucuacguauuccauauagucucacuuuaaagaacauuuuaugugccagacaugguggcucaugccuguaaucccagcacuuugggaggccgacgcagguggaucaucugaggucaggacaagaccaaccuggccaacauggugaaacuccuucucuacuaaaaauacaaaaaaauuggccgggcgcgguggcucacaccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccgaccugggggacagagcgagacuccgucucaaaaaaaaaaaaaaaaaaaaaaaaaaaaaaauacaaaaaaauuagccaggcauugguagcacgcuccuguaauuccagcuacuugggaggcugaggcgggagaaucgcuggagccugggagguggagauugcggugagccgagaucgugccacugcacuccagccugggugacagagcgagacucagucucagaaaaaaaaaacauuuuauguauauauauaaaaaauguggauagaaguuauacagacuuaucucuggauaguugggauuguggcugauauuuauuuucuuuuaaacuuuuuauaauuugcaaauguccuagaauaaguauauauaauuuauaguucuaaguguguaaugaacauuauuuuuaaaauaguugccuuuuuaauuacuauaacucauugaagugaaucugguuuuguauaacauaauaaauuguagaggagggugcuuguguuuaaccaguaguaguauggaauguaguuucaauuaggaaagcuuucagcugaaaauaacagaaaagcagauguaaacagugacauaaacaagaugggaguuuauuuuuucucauauaaucguaagucuagaggcuuggaguagcugguguuggcucagucauucagcagugucaggguagugucucuugaauucuuuggacauucuccauuguugcaaaauagaugcccaaauuacuggcaauguaccauauucaaggcuagagggguccugggaaggaagccagggaaggccacaccaucugccucuuucaucaggaaucuaauaucuuuucccaaggcaauuuuuagauuucacuuggcacaacuguguuauaugacuauccuuaggaagccaggaaagugaguauuuaguauuuuauagcccaaguauuagggacagaaaagggagaagggguugaaaauggaugucggauuaguuaacuaauggugucuaccacaaguaaaaaaacaaacaaaugaacaaaaaaacccagaaaaccuucaguuagauugcuagauucacuaauauuuugaaaauuuuaaaauaaauuaguuguugacugagaguuuuuuguuuguuucuuuuagcgcugucaauacuugccucugaguuuugcuaggcuaccuugaauuaugguguauuucuauuaauaguucauuuuaagugauuaguaguugugguaggcaggauaauagugacccaaagauguccacgucccaauuccuaggaccugugaauauguacauuacauggcaaaagggaauuaagauugcaaaacagcagauagggagauuauuuuggaucauucaggugggcccuuuaaggacuacacuucuuaaaaauggaagugggaugcagaagaggcgucaguaagagaugugaugauggaaacaaggucagagaugcaguguugcuggauuuggagaugggggaagagggccaugagucaaggaaugugguaaccucuagagacuggaaaaagcaaggauucacccuucuagccuccggaaaggacuguagcccuaccgauaucuugauuuuagcccagugagacaaguguuggacuucuaacuuuuauaacuguaagauaaagaaaugaauguuguauuuuccucuaaguuugugguacuuuguuacagcagcaauagaagacuaaugcagauuuugguaccuggaaguggggugcugccguaacaaauaccuaaaaauguggaaguagcuuuggaauuaugcagugagcacaucuggaagaauuuugaggugcaagauagaaaacgccuagauugccaugacaauagaaauauggauguuaaugacucuauuagacuuagaaaaaagugagcagcaggauagagaaaacauuuaucaucuuagagaauaccuaaaucauugugaacagaugguggaaaugcauuaaaggugcuggcucagaggaaaauguugggaauuagaggaaaagggaucccuguuauaguggcagaaagcucaucaggcuuguauacugcaauuacauggaaaggaggacuuacaaacagugaacuuggauguuuaacugaagagauuuccaagcaaaguguugaaguuauggccuaguuauggccuaguuucuuuuugccacuaauaguaaaauugaaaguagagaaauaagucaagaagagaccuguuaaacaaaaaggaaccagggcuugaugauuuuggaaauucuuagucuacccaaguggcuaagggugcuaaagucaggaguuucacggucaggaaaacgugcucuaaagaaaaagccaaaggagucacugcacaaccuuuugcugaaaccucagaaagaugaaaaggucagagcauucacucacacaaaacacugaagagaucaaggggugugacucauagauucccuuagcaucuaaguagaagccagaaauagagaugggauuaucuaggcaagaucuguggaggagccucuugucuaauggagugagucucuguacuuauacaguagacccacaagguuuuugagaauucuacgucagcagcaacucagagcuagagagagaggaugaagugaaagacucaaagaggaggcaaaauuccucuucaucuguggaccuauggaauuagaaaagaaaugagaggaugaagugaaagaaggcuaucagagccccaaauucuauaggcaggaaacaagccgaugaaacuacucagcuuuaaauacacgcugguuacccuuuaugaaaaaggaaggaagacucugagggcaaaagggcaguccuguaggguggaacugagaacuuuacagaauucugcccgugcagagaccuauuccagguugccuaacuggauuucagaauugcuugggaccaaugaugucuucccuuucacuuucuuucauuuugaaugggaauaucuguaacuauauccuacggcagucccguccuuguauuuugggagcaggggauuucuuuucuaauuccguagguccgaagauggagaggaauuuugccucaggauggauuauaccaagagucucacccacaccaaauuuagauuuugauaauaagauugagauuuuugaguccaugagauuuagaugagauuuuggacuuugaauugaugcugcaguguguugagacuuuggggggaucuuggaagggggugaaugaauguauuuugcuugugaaauggacauagcccuaaugacacagugauuuuagcccagugagacuuauguuggacuucuaaucuacagaacugaaaauaauaaauucauguuguuuuaagccacuaauugugguaauuuguuacagcaggaauagaaaacuaauauuauagaugaccuuucuguaugcauagaaaauuuguuggcuuggcaagaaaccauggagauuaaaaaaaucugaaggcacauacuucacaaaagaauauaugcaaauggccaauaagcacaauguucuuaacauuauuagucaucagggaaaugcaaauuaaaaucuuagugagauaggcugggcacgguggcucacgcguguaaucccagcacuuugggaggccgagguggguggaucaugaggucaggagaucgagaccguccuggcuaacacggugaaacccugucucuacuaaaaauacaaaaaauuagcugggcgugguggcaggcaucuguagucccagcuacucaggaggcugaggcaggagaauugcuugaacccgggaggcggagguuguggugagccgagaucaugccacugcacuccagccugggcgaccgagugagacuucgucucgaaaaaaaaaaaaaaaaaucuuaaugagguacagcauacccacuagaaugguuacaacaaaaaagcuugacaauacccaaauaaaaaagccuauuccaauaucgaacauuuggaacaauugaaacucccauacacuguagauaggaauguagaaugauacaaccaccguagaaaaguuuuggcaguuucuuauaaaguuaauuauauaccugcccugugaccaguaauaccccuucuagguauuuacucaaggaaaaugaauacauauauggccacaaaaaagacuguacaagaaugucauaacagccuuaugaggguucuucaaaaaguuugugggaaauguguguuaugaaaaaauauccauggaguuuguauuaguccauuuucauacugcuauaaagauacuaccugaggccaggcacagugccucacaccuguaaucccagcacuauggguggcugagguggggcggaucacuuuaggucaggaguuugagaccagccuggccaacauggggaaaccccauauaaaaauacaaaaauuagcuugaugugguggcacacgccuguagucucagcuacucaggaagcugugacaggagagucgcuugaaccugggaggcagagauugcagugagccaggaucucaccacugcacuccagccugggugacagagcgagauuccaucuuaaaaauaaauaaauaaauaaauauauauauacacauauauauauauacauauauauauacacauauauauaugcauauauauauauacguauauauauauacacacacaaacacacacuauccgagacuggguaauuuauaaaggaaagggguguaauugacucacaguuccgcguggcugggggaggccucaggaaacuuacaaucauggcagaaggggaagcaggcacaucuuacaugguggcaagagagagaaaagagugaaagcacagcaaaaacugccauuuauaaaacuaucagaucucaugagaacucacuaucacaaaaacagcaugggagaaacugcccccaugauccaaucaccuaccucccucaacacguggggauugcaauucgagaugagauuucgguggagaugacagagccaaaccauaucagaauucaaaauuuuuuugcacuaaaauauaaacucaugacuaacuuguuaauaacauguccgaacaguaacuagcuugagacacuaauacauccguuugaaaauaauccauuucagagcaacaucaauucugcuaaaauugaaacaagaacaaacauuacauuuauggugaacuuuggguagaagaauggugaaauuaucgauguguuacaaaaaagcauggcaauagugacccaaagaaaucagcaguuuacaaauggauaaguuguauuaagaagggaugagacaauguuaaccaugaagcccuucgucuucagcagcagaccaucuacaucaauuuguaaaacugaugauuaacagcagcaauagccaauguauggacaccucauuugguucagccuuacccaauucugacugauaaaauuaaaguugagcaaacuauuuaauggaugucaaaacuauugcaucuagauuggcugcaggcaagagcagagcuuuaaguggaaguuuuaaacaagugagaucaagauccugagacauuuccuugaggaauuauaacgggagaagaaauguggcuagcaguccaauccugaagacaaaguaugaucaaagcaauagcuaccaagagguggaaguggaagugguccagucaaagcaaaaguggaccugucaaaaacagggcaacaguuuuuggagaugcuugagggauuuugcuuguucacuuucuggagggccaaguaaugauaauagcuuauuaugagaguauuuagagaaaguuggccaaagcuuuaguagaaaaacacuugggaaagcuucaccagagaguccuucuccaccgugacagugucuguucauuugucucaucaaacaagggcaauuuugcaagaguguccguaggcauccaccuuagaguucuuaucuggcuucuuucuuuugcuuccuaaucuugaaaaaaaucucuaaagagcacccauguuucuucaguuaauaauggaaaaaugggugagcgugggggauguggcugggugggugccggggcuucaccuccaaggcaguggccggaucaugauugaggugauugagccccuggagccucuagugccuguggauuuuggcagucucgaggcagugguccgguuggagaaagacaucaucuucgcccaugggcuccaccccauggacaccgacggguggagcccauggagucgguccuggagggcagaugucuauaccugagaucuaacaauguaguagaaggcaacugugcugaagaauuacuacaaaacucccauugcgucgugaaggaguauuuuguggccccccagguaauaucucuuugccaaagcuggaugaacaagagccuuucucacacagccgaguagcucauucuggaaaggggguacucucugaauacguggaagcaugaggaccauauuuucuuacugugaacacuaauuuuccugcuuuuuccagucaccugaaaaaauggaugcuuaagcauuucuuuucuuuuuuuuuuuuuuuuuguuuuugggaugaagucucgcucuugucccccaggcuggagugcaauggugugaucucaucucgcugcaaucucugccuccuggguucaagcgauucuccugccucagccuccugaguagcugggauuacaggcaccugccaccacacccggcuaauuuuuguauuuuuaguagagaagggguuucaccauauuggccagguuggucucgaacuugugaccucaggugaucugccugccucggccucccaaaaugcugggauuacaggcgugagccacugcgcccggccagcauuucuuaauagcagacucuucugaagacagaauugggaaauaucuggcaccaacaaggcaaugaguuccugaugcuaacugaaguaaaaggaaagcaaaagucagcuuccaaggaaauagcuuccaagguauucacuuaacaggccuguucaguauggaagacacuauuuaucccccuuuaacucucgccaaaggacuauaccaacugcaugaaagugaacuuuuacaucuacuuaaaugguagauggagcaccuugaucacuaugugacaaccuugguugucauuuuuaguugcuauuugaauugauuugagcagcccuaucuucaccggacauaccugaauuuguuccuagguacccacuuuguuccuagaaaagggcuaacuuucuacuauggucugaagaguguucaaaguagacuagagcuugggaacuccuaaccuagaaccaucugccaucccacaaagugauuagaugcaaaagggauacuagucauaccuaguguuucucuuucugaaaagagaacuuauccuaaaaguagccaugggccugggacaaaguagcccuuuccacccccaaaaugauuauuagauugacgugaguccaagauuguggaguuuuuuguuuuuuguuuuaaaacagauaccaagaauaaaugaaaccuauuuagggauucauucucuaauuaauagauucuaaguaauagaaucggagagagacuuuuuccucuaaccaaacugccaaaguuguuuuuggcuaagaauuucccaaugaucuuugcacugcugcucauuucuuuuauuuuucugagauagggucucucucugucacccaggcuggagugcaguggugugaucacagaucacugcaaccuccaacuucugggcucaaguuauccucccaccucagccuccugaguagccaggacuacagguguguaucaccgccuccaguuaauuuguguguguguuuuuuuuaaauagagauggggucuuguuauguugccuaucuggucuugaacuccuggccucagaggauccucugacaugccuuggccucccaaagugcugggaucacaggcguaaaccacgaugcguagcuuguuacucauucuuaaaagucuguguuuauuuuucccauucccuucuuuuaucugcaguccuucuuuuuucuuuaaggcagcuuaauuuacaagcuuggccuugaguuaaaagagaaccccgaacguugaaguugaaguucucaaaccaacaucagagcaacuaucuuaauccccauauaaacaaaguuaucuacuccuggcuccuuaaaaaaauaauaauaauguaaaaaugacugcauugacaugcuuacauucccagcaacuucaauuguuuagggauggacuaaaugacugguaucaucacuuuaaaaugugucuugaacuugauggagcuaugucgauaaauaaaauuuauaguuuuuguggguuuuuuuuuuuuugagacacagucucgcucugucgcccaggcuggagugcaguggcgcgaucuuggcucagugcaagcuccgccucccggguucaugccauccuacugccucagccucccgaguagcugggacuacaggugcccgccaccacgccuggcuaauauuuguauuuuuaguagagacgggguuucaccauguuagccaggauggucucgaucuccugaccucaugauccgcccgccucggccucccaaagugcugggagccaccgcgcccggccuauaguuuuuguuuuuguuuugagacggagucuuguucugucacacaggcuggaguggaauggugugcccuuggcucacugcagccuccgccucccaggcuuaagccuuccaaguagcugggauuacagcugugugccaccacgcccagcuaauuuuuguauuuuuaguagagaugugguuucaccauguuggccgggcuggucucaaacuccugaccucaagugaucugcccgucuuggccucccaaagugcugggcuuacaggcgugagcuacugugcucagccguuagguuuauuuuuuaauuccauuuuuccacagauuuuuugaaguccccucguauuugugauagcccuaaacuggaaacaucccaaaugcucaucaaagaagaaggaacaaauugugguauauucaugcaauagacuauuacucagcaauaaaaggaaaaaauugcugauucaggcaacaacauggauaaacuucuaaaacauuuauguuggaaagaaaacagacacaaaagaauauaugcuggaugauucucuucguauaaacuccaagaacagcccccaaacucaucuguggugauagaagucagaagucuacuggguuagaggaaauugauuggaaaugggcaugagggaacuuucuggggugauggaaauguucaguauuuuuauuuuggauggagguuacauagaugaucacaauugccaaaacugauuuagcauaauauuucaguuguccauuuuauuguauaaauuacagcucggugaaaaaaaaaaagagauguaguuagugucuuaacuaacuaaauguauauugacaaccugauuuuacuguucuacucauuacaagaaggcauacccuuaugugauggcacccacccagugaaagucuggaauugaguccugagagaauugaggaauugagaauugagagaauugaggaauugagaauugagagaauugagaauucuggaauugaguccugaggaaugauccaucacucacauuaggaaguacucuggggagugggcaucaguaugugagaaguuacgucccgguuucagaaaaucaaaugaaaaauucaaagaccaugguuuaggaagaaauaaauggguuguagaaacuguuaucagcuaggcaguuuugaaaucaauugugccgauaauguguggauucggguagggggagaaagauacuuugugcuuccuaaggaaacuaaaugcuaaguucauccacuuaguaagaaauauacaagcccgaaacaacuuuucuauuugaauggugcagcuguuccugaauaauuacuucugaagauuuacugccaggaaaugguuuagaacaagaaaaugagauacuauuaugacuuaaccaccacuguagugaaacuccucucaaagauuuccaguaacuucuuacuuaguuaauuuuaaaaguuaauuuucuguccacauuuuaccugaccucuuucccaguuuuaacaugguuaaauacuuccuggaguuguaccaucuuuggcuuucagaaaccauaguccuggauuuccucuccucuuugauuucuccauuuuauccuaugauagcucagaaguggcugguuuucuucugccugucaucuaaauauugguauucccuaggguucauaucagugcuguaguucuuucccaaacucaucaugcucuuugauacccuuuauauuuguacaugcuucucccugugccuggaauuauucuguugccuuuuccacauagcucaaauacaugucauuauagguacugacuuccuucuucuucuuucuugacagauuagucauugucuucucuguuguucucuuuuuuuuuuuuuuuuuuuugagagguagggucuugcuauguugauuagguuggucuugaacuccugaccucaagcaguccucucaucucagccuccccaagugcuggaauuacaggugagagccacuaccccuagccucgguuguucuaacacuugauuuuuuuuuuuaaccucuguucuaguauuuuaauauauuguacuauaauuauuugcauaguuuuucugccuucugaauuauuaauucuuugagagaaagaaacacauauaacuuuguaucaucaauaccuggaaaagugcuuuguauuauuagacaugcaauaaaaguguugcaugaguuaaaagauaauccauuuucucucuucaagcaagggaguuggaaucagaaggauuauuuauuucccucucuaccucaggaaagcacucacacaggcagaaguggagaaagguguguuaauguguguugagaaaccuuucugucuccuacuucccuucucuuuuuccugcccaguuugcaagccaacuuuccugauuuauuuggauuaacacuuauuuuauuuuaaaaugaaauuggggcagacuuuucaggaaagaugaugaagugaugccacgucucaaaacuuccuucucuaaagccuagugaaaugaacaacagugaauaaaagggaaagccaggagacuucuaauucuagccaagaugaaauaaagcuacuggagcccaucuuucccagugauuacaaauaauaaauaauaauaauaauaauaaauaacaacccuggacaaaaaaacaaaaacaauuaccugaagccuccaaauaguaaauauaguaggugaauuagggagagaaaacaauacuuaaugaaugaccaauauagcaacagugaguuucaugguuaauuuucaucuuuauaccuugaguuugacccaagggcagacugaaucagggaacuauauaguagguguggucaauagagacugagaaagaagcccaucucucuggccugagcacaguuuacaaaaaaaaaaaaaaaaaaaaaaagguugguggugacugcaagcuggagagcugggggagaauccuuguuuguuuguuuguuuguguuuuucuuguuuucuuucccguccugaggucagcccuaguuguggaacaacuuuacuaggauacgacagcaauguugugagcacuuaaaacccucggaagaaaccuaccacugagaaaagggacggcuguugggugaagagugggggaaaagccacaucauuauuuuuucuuucuaucuuuucuuaccucuucaucaugaaggugggcccacuugcauaguacagggagcugaaacucuugagagaaccccauauuucuggcugacgaccugggaaaggugucuuugacugccagaugguaugggaaaaaagauaugaggaaagacauggaggaauggauaauuuaccaaagcacuacauguauggacuauuccuaaagaagcauagcaaaagcuuugaaguauaaacugacauuggaaucaauaugcacagaaggcgaggcagaacuuguaaucugaaacuaacuggguugauuccuugcuaaaacaaaaaagucaguaguccccagaggcuuuuaauaggauccagagucucaugacauaaucaaaauaugcaggauacaauccaaaaccagucaaccaggaaaggaaauugauuccauugaaccaauguuaaucucuacaagugugucauuuugggguugguaucuguugauuggaaaaaacuuggaaauuuucaagggaaaagauaaucaauagauacccccaaaaugacccaguuguagggauucuuaaauacuuuaaagcagcuacugcaaccauguacuauaaaggcagacacucuugaaaucaauggaaagaggaauucucagcagugagcuauauauacaaaaccaaaugaaaauucuagaaaugacagacuauaauauguaaaguaaaaagauucauuagcucagacguggagguguggcuggcaagauggccgaauaggaacagcucuggucuccagcucccagcgagaucaacguggaaggcgggugauuucugcauuuccaaccgagguacccggcucuucucacugggacugguuagacagugggugcagccccuggaggucaaguugaagcaggauggggcauugccucaccagggaagugcaagggguuggggaacucccuccccuagccaagggaagcuauaagggacugcaccuugaggaauggugcacuucagcccagauacuacgcuuuucccauggucuucaaaccugcagaccaggagauucccucuggugccuacgccaccagggcccuggguuucaaggacaaaacugggcggccguuugggcagacaccgagcuagcugcaggaguuuuuuuuuucauaccucaguggcgccuggaaugccagcgagacagaacuguucacucuucuggaaagggggcugaagccagggagccaaguggucuagcucaguggaucccacccccacggagcccagcaagcuaagauccacuggcuugaaauucuugcugccagcacagcagucugaaguugaccugggauacuugagcuugguguggggggaggggugucugccauuacugaggcuugaguaggugguuuuccgcucacaguauaaacaaaggugcccagaaguuugaacugggcggaacccacugcagcucggcaaagccucuguagccagaccgccucucuagauuccuccucucugggcagggcaucucugaaagaaaggcagcagccccaguuaggggcuuuuggauaaaacucccaucucccugggacagagcaccugggggaaggggcggcugugggcacaguuucaguagacuugaacguuccugccugcuggcucugaagaggacagcagaucucccagaacagugcucaagcucuccuaagggucagacuaccuccucaagugggucccugaccccugugccuccuuacugggagauaccucccagcaggggucaacagacaccucauacaggagagcuccagcuggcaucuggcaggagccccucugggacaaagcuuccagaggaaggaacaggcggcaaucuuugcuguucugcggccucugcuggugauacccaggcaaacagggucuggaguggaccuccagcaaauuccagcagaccugcagcagaggguccugacuguuagaaggaaaacuaacaaacagaaaggaauagcaucaacaucaacaaaaaggacauccacacagaaaccccaucugaaggucaccaacaucaaagaccaaagauagauaaauccacgaggcugaggaaaaaccagugcaaaaaggcugaaaauuccaaaaaccagaaugccucuucuccaaaggaucacaacuccuugccaacaagggaacaaaacuggacagauaaugaguuugacaaauuggcagaaguaggcuucagaggguagguaauaacaaacuccucagagcuaacggagcauguucuaacccaauguaaggaagcuaagaaccuugaaaaaagguuagaggaguugcuaaguagaauaaccagcuuagaaagaaaauaaauaaccugauguagcugaaaaacacagcaugagaacaucgugaagcauacacaaguaucaauagccaaauugaucaaguggaagaaaggauaucggagauugaagauaaaucuaaugaaauaaagugugaagacaagauuagagaagaaagaaugaaaaggaaugaaaaaagccuccaagaaauaugggacuaugucaaaagaccaaaccuacguuugauuggcguaccugaaagugauggggagaauggaaccaaguuggaaaacacucuucaggauauuauccagaagaacuuccccaaccuagcaagacaggccaacauucaaauucaggaaauacagagaauaucacaaagauacuccucgagaagagcaaccccacaacacauaauugucagauucaccaacguugaaaugaaggaaaaaauguuaagggcagccagagagaaaggucggguuacucacaaagggaagcccaucagacuaacaguggaucucucugcagaaacccuacaagccagaagagagugggggccaauauucaacauucuuaaagaaaagaauuuucagcccggaauuuuauauccagacaaacuaaccuucauaagugaaggagaaauaaaauccuuuacagagaagcaaauccugagagauuaugucaccaccaggccugccuuucaagagcuccugaaaggagcacuaaauauggaaaggaaaaacaagugucagccacugcaaaaacauaccaaaugguaaagaccauugacacuaugaagaaacugcaucaacuaaugggcaaaauagccagcuagcaucauaaugaaaggaucaaauucacauauaacaauaucaaccuuaaauguaaacuggcuaaaugccccaguggaaagacacagacuggcaaauuggauaaggagucaagauccauugguguacuguauucaggagacugaucucacaugcagagacacacauaggcuuaaaauaaagggauggaagaauauuuaccaagcaaaugaaagcaaaaaaaaaaaaaaaaaaaaaccgguugcaauccuagucucugauaaaacagacuuuaaaccaacaaagaucaaaagagacaaagaaaggcauuacauaaugguaaagggaucaaugcaacaagaagagcuaacuauccuaaauauaugaaauauaaaugcacccaaugcaggagcacccagauucauaaagcaaguucuuagagaccuacaaagagaccuagacucccacacaauaauagugggagucuuuuaacaccccacugucaguauuagacagaucaacgaaacagaaaauuaacaaggauauucaggacuugaacucagcucuggaucaagcggaccuaauagaaaucuacagaacucuccaccccaaaucaacggaauauacauucuucuccacaccacauuggacauauucuaaaauuguccacauaauuggaaguaaaacacuccucagcaaaugcaaaagaacagaaaucauaagaaacaguugcucagaccauggugcaauccaauuagaauucaggauuaagaaacucacucaaaccauacaacuacauggaaacugaacaaccugccccugaaugacuacuggguaaauaaugaaauuaaggcagaaauaaauaaguucuuugaaaccaaucagaucaaagauacaacguaacauaaucucugggacacagcuaaagcaguguuuagagggaaauuuauagcacuaaaugcccacaggagaaagcaggaaagaucuaaaaucuacaccccaauaucacaauuaaaagaacuagagaagcuagagcaaacaaauucaaaagcuagcagaagacaagaaauaacuaagagcagagcagaacugaaggagauagagacacaaaaaauccuucaaaaaaucaaugaauccaggagcugguuuuuugaaaagauuagcaaaauagauggacugcuagccagacuaauaaagaagagagaagaaucaaauagacacaauaaaaaaugauaaaagauaucaccacugaucccacagaaauacaaacuaccauaacagaauacuauaaacaccucuaugcaaauaaacuagaaaaccuagaagaaauggauaaauuccuggacacacacacccucccgagacuaaaucaggaagaaguugaaucccugaauagaccaauaacaaguucugaaauuguggcaguaauuaauagccuaccaaccaaaaaaagcccaggaccagacagguucacagccgaauucuaccagagguacaaaaagcagcugguacuauuccuucugaaacugcuccaaacaauagaaaaagagggacuccucccuaacucauuuuaugaggccagcaucauccugauaccaaaaccuggcagagacacaacaaaaaaagaaaauuucaggccaauaacccugaugaacaucgaugcgaaaauccucaauaaaauacgggcaaaccgaauccagcagcacaucaaaaagcuuaucuaguaugaucaaguuggcuucaucccugggaugcaaggcugguucagcauacacaaaucaacaaauguaauccaucacauaaacagagccaaugacaaaaaccacaugauuaucucaauagaugcagaaaaggccuuugauaaaauuaaacaccccuucaugcuaaaaauucucaaaaaacuagguguugauggaacguaucucaaaauaauaagagcuauuuaugacaaacccacagccaauaucauacugaaugggcaaaagcuggcagcauucccuuugaaaacaggcacaagacaaggaugcccucucucaccacuccuauucaacauauuauuggaaguucuggcuagggcuauuaagcaagagaaagcaauaaagguauucagauaggaggaagucagauugucucuguuugcagaugacaugauuguauauuuggaaaaccccaucaucucagcccgaaaucuccuuaagcugauaagcaacuucagcaaagucucaggguacaaaaucagugugcaaaaaucacaggcauuccuauauaucaauaauagacaaacagccaaaucaugagugaacucccauucacaauugcuacaaagaauaaaauaccuaggaauucaacuuauaagggaugggaaggaccucuucaaggagaacuacaaacuacuucucaaggaaauaagagaggacacaaacaaauggaaaaacauuccaugcucauggauaggaagaaucaauacugugaaaauggccauacugcccaaaguaauguguagaaucagugcuauccccauuaagcucccauuggcuuucuucacauaauuagaaaaaaacuacuuuaaauuucauauggaaccaaaaaagaucccacauagccaagacaauccuaagcaaaaagaacaaagcuggaggcaucacgcuaccugacuucaaacuauacuacaaggauacaguaaccaaaacagcgugauacugguaucaaaacagauacauagaccaacggaaaagaacagaggccucagaaauaacaccacacauuuacaaccaucugaucuuugacaaaccugacaaaaacaagcaauggggaaaggauucccuauuuaauaaaugauguugggaaaacuggcuagcuauaugcagaaaacucaaacuggaccccuuucuuacaccuuauacaaaaauuaacucaaaauggauuaaagacuuaaauguaagaccuaaaaccauaaaaacccuagaagaaaaccucgguaauaccauucaggacauaggcaugggcaaagacuucaugacuaaaacaccaaaagcaauggcaacaaaagccaaaauagacaaaugggaucuaauuaaacuaaagagcuucugcacaaugaaagaaacuaucaucagagugaacaggcaaccuacagaaugggagaaaauuuuugcagucuauccaucugacaaagggcugauaucuagaaucuaccaagaacuuaaauuugcaagaaaaaaaccaccccaucaaaaagugggugaaggauaugaacagacacuucucaaaagaagagauuaugaaauaaagcucaucaucacuggucauuagagaaaugcaaaucaaaaccacaaugagauaccaucucaugccacuuagaguggcgaucauuaaaaagucaggaaacaacagaugcuggagaggauguggagaaauaggaaugccuuuacacuguuggugggaguguaaauuaguucaaccauuguggaagacaguguggcgauuccucaaggaucuagaaccagaaauaccuuuagagccaguaaucgcauuacuggguauauauccaaaggauuauaaaucauucugcuauaaagacacaugcacauguauguuuauugcagcacuguucacaauagcaaacacuuggaaccagcccaaaugcccgucaaugauagauuggauaaagaaaauguggcacauauacaccauguaauacuaugcagccauaaaaaaggaugaguucauguccuuugcagggacauggauaaagcuggaaaccaucauucucagcaaacuaacacgggaacagaaaaccaaacacugcauguucucacucauaggugggaguugaacagugagaacacauggacacagggagaggaacaucacacaccggggccugucucgggguggggggcuagaggagggauaucauuaggagaaguaccuaauguagaugacagguugaugggugcagcaaaccaccauggcacauguauaccuguguaacaaaccugcauguuccgcacauguaucccagaacuuaaaguauaauaauaauaaaaaaaaucauugguucaucucaguagcagaauggagaugucagaggaacagguuagugaauuuaaagauaaaccaguagaaauaaaucccaacugaaaagagagagagaaaaaagaaaacaaaaauaaacagccucacuggccugugagacuguaucaaagggccuaacauuugugacauugaagucccugaagaagaggagaaagguauuggugcgaaaaaaaaauuugagaaaauaaugacugaaaacuuacaaauuuggagaaagauaaauuuacagacucaagaaacuaagugaaacuuagacaagguaaauucaaaggacucugcucucagucacuuaaugaaacugcugaacaccaaagaugaggaaaacuguugaaagcaccaagaggaacaugauucauuacauauacacaucacuguggguuucucaucagaaaaucuggaagucuaaaaacaguggaacaccaacuuuaaagugcugaaagaaaggaagugaugacucagaauaccauauccacugaaaauaucuuccaggaaugaaggugaaauaaagacuuccucagauguagguaaacuaaaagguauuugucaccagcagaccugcucuacaguaaauauuauaguaaaugaaguuuuuucaggcugaagggagaugacacuagauugaucccaccaaaacaacauauggauaguacuuaaagaaaacaacaacagcugaaaacaacugucaauccagaauucgauuuccagugaaaauaacuuucaaaagugaaggugauaaaaaggcaauuucagacuuaaaaaccgcugaaagaauuuaucucugacagagucacauuaauuauaaaagggauuuuuuucaccaggaugaaaaugauaaugaagauauggaucuaugcaaagaaaugaagaauacuggaaauguuaaacugaguagauaaacaagaaauuuuccuuguuuacguaauuuuaaaaguuaauugacugcuuaaagaaaagaauuuaguauggaguuuauaacauauguaaaauaaaaucugugacaaaaauagcaugaggcaaagaagagaaaugguacuuuauuacuauaaaguuuguauccucuuuaugaaguguuuuagcacuugaagaaaaucuaauagguuaaagauuuacuguauaaagccaccacuaaaauaacaaugcagaauuauagcuaauaagccaacaaaagaguuaaauagaaucauaacauauauuccacccaaaagaagguuggguaggaaaagaaaagggaacaaaauucaggccaggugcaguggcucacaccuguaaucccagcacacugggagaccgaggcagguggaucgccugaggucaggaguuggagaccagccuggccaacauggcgaaaccccaucucuacuaagaauacaaaaauuagccaggugugauggcacgugccuguaaucccaguuacucggagaaucauuugaaccugggaggcggagguugcagugagcccagaugaugccacugcacuccagccugggugacagagcaagucuccaucucaaaaaaaaaaaaaaaaagaaaagaaaaagaaaagggaacaaaaaccagaugagaugaauggaaaagaaauagcaagaugacagacuccaacccaaccauaucaauaauuacauuaaaggcaccuauucuaaacacuucaauuaaaagggaaagauggcuagauuggauuuuuuuuaagagauggggucacucagugcagugacaugaucauagcucacugcaucuuuaaaccccugggcucaagcgguccucccaaguaguuggaacuacaggcauuagccacugugcccagcucagauuggauuucuuaaaaaagccaaauccaacuuuaugcugccuauaaaaacauaccuuaaauauaaagaaacaaauagauuagaaguaaaaagaugaagcaagauauaccaugcuaacuguaaucacaagaagcuguaugucuucagauaauguagacuccagaauaaauaauauuacuagggauaaaggggucagcuuaccaagaggacaaaguaauauuguuuauggagcuaauaacagaguuucacagugcuugaaacaaaaauugguagaauugaaaggagaaaucaacagauccacaauuaaagcuggaaauuucaguacucaucucucaaaaacauagagcaaguauacagaaaaauuauuaaggaaaaacaauuugaacaagaaaacugagacucuuugcugaugacauugucuauguagaaaauuuguggaauccaacaaaagcuacaggaaguaauaagugagcuuagcaaauuugcagaauacaagaucaauaugcaaaaaucaauuauguuguauauacuugccaagagcaguuguaaguugcaauuaauccuguuuacaguagcaucaaaauaugaaauacuuuggggugaaucugaugaaagauguauaagauauauagacuaaaaacuacaaaacauuggugauagaaauuaaauaagaccuaaauaggggccgggugcgguggcucaaaccuguaaucccagcacuuugggaggccaaggcagguggaucaugaagucaagagaucgagaccauccuggccaacauggugaaaccccaucucuacuaaaaauacaaaaauuagguaugguggcgcgugucuguaaucccaguacuugggaggcugaggcgagagaaucacuugaacccgggaggcagagguugcagugagccgagauugcgccauugcacuacagccugggcgacaagagcgaaacucugucugaaaaaaaaaaaaggaaaggaaagaaagaaacaaaaugcuaguaauuaaaaacaguagcagagaugaagauugcuuucagauucauucguagacuuaacacagccaaagaaagaauaaauguaccugaagauaggucuauaaaaaugccuaaacugacacacaagaagacuuccuaaaaaagaauuucaagagcugagagaauaucaaacagacuagcauauguagaauuccaggagaagggcuaggcgugguggcgcaaacuuguaaucccagcacuuugggaggccgagguggguggaucaccugaggucaggaguuugagaccagccuggccaacuuggcaaaacccccucucuauuaaagauacaaaaaauuagccaggcaugguggcaugugccuguagucccagcuacucgggaggcugaggcaggagaauugcuugaacccgggaggcagagguugcagugagccgagaucacaccacugcauuccagccuguaugacagagugaaacucugucucaaaaaaaaaaaaaugauaauaauaauaaaauuccagaaggagaaaggagagagaaagcauuugagguaauaauggccauuuuuuuccccaaaauuaauuacagacaacaaaaugcauguccagaaagcucaaagaacaccacaugggacacauacacauaccucuaggcauaucagugaaacugccaaaaagaaaauuuaaauagaaaauuuuaaagguaccccccccaaaaaaggacaaaacauuauacaaauagaaacagauuauaguagacuguuuuuuucagaaaacaugcaagcuagaagacaauguugugucaacugauaauuuuauacccagugagacuaucuuuaaaaggugauagaaaaguaaagacuuacuaauuuaugagacagcaucuugcucuguuguccagguuggagugcaguggcaugacuccugugcucaagcagucuuccuaucucagccuccugaguagcuaggacuacaggcgaacacuacuaugccugacuaauuuuuuauuuuuguuuuuguagaaagaggucucauuacgaugcucagacuggucuugaacuucuggcaucaagugauccuccugccucggccucccaaagugcugggauuacugggaugagccacugugcccagccuaaagacuuucuuacacaacaaaaacugauaauuuauugguagcugucuuacucugcaagaaauguuaaaggauauucuucagauagaaggaauaugauaccaagcagaaacuuggagcuacacaaaaagaacacuggaaacaagccagggcaaaaucacauucacuuuuuucuuuuugaaaaauuauucuggacaauagcuguaugucuaaaacaaaaaauaguaguguaauguguuuaaagcauauauaaaaauauauuagaacaauugcacaaagaauagaaggaaaguauugggaauauacccuugagagguucuuauucuagccaugaagugauacucuuaguuauuaaguaaagauauaaacccuggggcaacaacuaaaaaaaauuuaaagaaguauaaacaauaaacuaguaaaggaaguaaaauggaauaauaaaaauaguugguaccaaaguuauuaaaggaaaaaaguguucaguuaacccaaacucaggcagaaagggggcggggguagaggagaugggcagagaaacaaagaccagauggaacaaauauaaaacuagccagaccacagacugauuugaggaauaauaaaacuguagucuccugcaaaacaacaacaaaaacaaaaacagaaaacaaacuaacaagaccacagauuucaauccagucauaaucaguaauuauauuaauaauggauugucuaaacacaccaguugaaugacauguauggacuucucguuaguugaagacaaugaaggcuguauacuaaucaaugacucaaaaucucccuaaaugauaagaaacaauuuuacaacuacaguuguucuugguaaaacuacauccucagaguuauuucaguucagagaauacugaaaaguaugaaaccacuuugaguaaaaagaaaaacugccaaaugccaguaugguaauuccucaucccuccccugaaccgcaccccgccccccgaaccacaccccccaccccccgcauccccaaagucuuuggggcaagcaguggccaaccacuaagguuguagauagauagaagagggagguuagcaaccaccaggcaggaacaacaacuagaaagauuaaaguuguugcuguggguagugacuaucuggggcuggugucaugaagacgguaaaaagaauugcccaagauggguguagguaaagaaagacggauucuuuaaaaaaguggaaacauguugcuagggugcaauggcccagucagcaagaguggagcugacuucagggagacaaaggcuugccugggauuuuauaggauggugcucuugcugugcugaagagggcuuugugcaguacugauaacaccaagguugcaguuagcuaacuugcauuuuucuauuagcugauggucuagugauaaguugggcauaggaagauugugaauuauuugugcaggagggcuauguguccuagaccaugaagaaaggccgacuuacagcuuaucugcguucucuuuuugcuuuuccuugguccugccagccugacuucuuuucccugauuaggacuccacaguuguaauucagaaaauacuaaaaaguuaguggggaagauaagagcauuuacuauaggaaacggauuucaaaguguacuugauuuaaagauuuaagcacaauagaaaagccugggcaacauggugaaaccucaucucuaccaaauaaggaaaauacguaaauuacgugggcauggugggcaugcuuguggucccagcuacucaggaggcugagaugagagaauugcuugagccugggagguggagguuugccaugagccaguaucgugcuacugcacuccagccuuggcaacagagcgacccugucucagaggcuagacauacaauuuaaagagaaauacucaacauaaaagggcaaauguaauuuaaaaggaccaccacaacauaaagggacaguguuccaaacauacacuucuccaggagaaaaaaggcaaaaaggaaaaaagaagugccuuuuggcaaucaggugucaaugggaaaaggaaggaaagguggauauuuagggucuuucaaggucuaaguguaagaguuaaagaaagaggaaagaaacaugaaaagcagcucaacagucaaagauagguuuauuuuggagaauaaacaugagagggacuucuggccgauuucguucaggagcgcucucucuuauagacuaagaguauucauuagccaggcaugguggcucacgccuguaaucccagcacuuugggaggccgaguuggguggaucaugaggucagguguucgagaccagccuggcuaacaaagugaaauccugucucuacuaaaaaauagaaaaaaaaaaaaaaaaaaaauuagccuggugugguggcaggcacucgggaggcugacaucucucugucccgaggggaaguugucucggggcuggcaugucucuggucagggagggguuuauuuuaugguuggaauguuucugguuggagaugucauuugugauuuauggucaugcugaauuugggggaaaaaaggcaaaucacuacauaacuacauaucagaaucuauagacuauauagcacugcaagaugacuguaguuaacaguuauuuauuauguauuuucaaauagcucagagaggauuuugaauguucccaguaaaagaaaugauaaauguuugaggagauggaugugcuaauuacccugaugugauaacuaugcauucuauguaucaaaacaucacuguguaccccaucaguauauacaauuauuaugugucaguuaaaaauaaauuauuaaaucuauauggugaauuaaaggagugaucaaagaaaaacucauugcaguaaauaccuuuuaucaaugaaaaggaaggaauaaaaagugaauuaaauucuuagcucaaaaaaacuagguaaagaacaacaaaguaauucaaaagaaagcauaugauaggaauuaguauagauaaaaacagaaauuaaugaggaaaaaauagaaaaacauaucuaauuauuaaaucaaaauccuauuuuugaaaaaauuaacaauauaaauaaacccguaagcuaaguugguaaaaaaaaaaacggagaaagcauaaauaugcaaaauaaaugacaagggagaaacagaagaaauguaaaaaucaaaagacaaauuuguagucuuugaaauaaauuugaaaccuagauuuaauggauaauuuuuuaggcaaauacagcuugucaaaaaugacccccuuuuuuuuuuaauggggaaacacuagaggcauuuccacuaagaucaggaaccacagcaaggauguucauuaucuucacugcuauucaacauugugcuggagguauuuagcaaugcaguuaggcaagagaaaccaaguugaaacauaagaaugaguuaacaaagaaguaaagcuaucuguuuuuagaugaugugauugaauaccuaggaaccccagauaaucaguaauaaaaugaacucaauaauuuagugggacagcaggauauaaaauucauauauaauaaucaauagucuucuuauuucucaaaagaagauauacagacagccaacaaacauaugaaaaaaugcccaacaucacuaaucaucuaggaaaagcaaauuaaaaccacaaugagauaccacuuuauuucugccagaauggccguaauuaaaaagucaaaaaacaauagauguuggcauagaugugauaaaaagggaacauuauuacacugcugaugggaauguaaauuaguacaaccacuauggaaaacaguauagagauucuuuaaagaguuaaaaguagaacugccauucgacccagcaaucccacuacuggguaucuacucgaaggaaaagaagucauuauaugaaaaagacacaugcacaugcauguuuauaacagcacaguucacaauugcaaagacguggaaccaaccuaagugcccaucagucaacaaguagauuaagaaaauguaguauguauauacaccauggaauacagccauaaaaaggaacaaaagaaugucuuuugcagcaacuuggauggaacuggaggccauuauucuaagucaaguaacuugaauggaaaaccaaguaucguauguuuaacuuacaggugggagcuaagcuacaaggacacaaaggcaaaagaaugacauaauggacuuuggggcuuggaagaggggaagguuaggagggggugagggauaaaagacuacauauuggguaccguguacacugcuugggugaugggugcacuaaaaucucagaaaucaccacuaaagaacuuaucuauguaaccaaaaaccaccuguaccccuaaaacuauugaaauaaaaaaguaaaaaaaaucaauagucuucauagaaacagcacauagaggacauaauaguagauagaaccccauuuacaacaacaaccaaaaagauuaaacacucaggaauacauuugacaauaaauguacaaaacuuagaaaaaauauuaagccccuuacucuugucugaauguuuguguccccccaaguauguauuuucaauuccuaaccuccaaguucaugguguugggaagugaggccuuugggggugauuagauuaugaggauggagcccuugggauuggaauuagugcccuuaugaaaagacugcagagagcuagcuagucucuucuaccaugugaagacacagcuagaagagaugccaucugaaccaggaaacaggaccuugccagucaccagauuugccaguaucuugaucugggacuuccuagacuccagaauuaugaaaaauaaauguuuauuguuuauaagaaaccuagucuguaauauuuuguuauagcagcccaaauagacuaagauauuccugaaagacucaaaguauacuuaaacaaauauaaagauaccuuguuuuuugaaaaaaaaaauuguuuuauuuuucaauuuuuuuccuugagacaaggucucauuauguugcccaggcuguccucaaacuccuggcucaagcaauccucccaccucagccuucugaguagcuggggccguagcaugcaccaccaugcccagaguuauugccuguuuuuuaauaggccaacucaauguuauaaaaauuuuauuccucccuaaacuaauuuauaaauucaauggaaucccaaugaaaauaccaacaggaguuaggcagguugguacuaaaguucacguggaaaauauaauguaagaauagcugggaagucacugaaaaaggaaaaccaugagggauuggguagaggggagaggaagcuagcucuacuagucaguaaaucuaaggcguguacaauuaaaacagcaugguacuggcacaugaacagacuaacagaccguggaauaaaauuguguggugacucuauaauguggucaccuuggucagacugaucuauguuuuucagauacaaucugauacaaauggaaaguacagaauuagacccauggaauagacuaagacagcaucccaucuguaccccaaaugugaauuagagacccugguuccuggggccaguguuuuucaggugugaaaagacagaagcauuuaacucauuggcccuugauuccuguugguugaggauuaucuuuagcacagaaauaccccacacuucaggauuauauauuucugagugacacguuggcaaccacaggcagcugacacucccaugucagagaagucagggccacaaacugagccaguuugcauauuuggaaugaugaucacuguuaggucacuuuggauucuucauucuagugaagguaaggaaagugcuaccguacucauagaggucauugaccuugauuccugucaggagcuaggaucauuucuguauaaugguggcagaaaggacucugucuagaauucaugguauucccuugaguauauuuuggugcuuucuugccucugacaguggugguagggguagagaacaaucagugguucaaucagggugcacccaacacagggcuuacauccuuugggauaaagguuugagucaacuauuggagaaguagccaaaaccagguaaagugcuggccaguggggaaggaaauguagaaugggugguuuuaggaaggagaugaugaauaucaauuauggccuuggaauuaguuguagcagcaaggauugaacuauguuccacucaccuuccuuuauuuagucuuuuguagaaauagugauugcuaccgucuugaagccuccaugauagauuagacuuaauggaggacaugaacaaauuugagggauggaaaggguagacuguauuggacaccucuuuugagccacuucacauggucucaggccuuaucugugauuccagcuguggcaucaugagcaagucuuuuggggcucagcucacuggcauuguuacugccuuacuucagguaugcacugaguguuuuuugccuacucagauucacuugcagcucacguguauacuccccagaaguaugggggaauuaauacucugggguuaacguucagccaggggcuaacaguuagugguucugagauguauuucauaaggcuccucggaagauugcucauuaaauaaccaguggccagcaucagugacccacucaaggaaaggucuuuauauuguuuuuaccuccuucccuguucauuucccugucauucacuucaccgucugaacaccuuccuaaauaaacuaccuuuaugcaagccuuugcugucaggacagccaaagcuaugacagagguauagaacauggguugacaagcuaugguacauggccaaaaccauguaaauaaaguuuuuuuguugucuuuuuuuuuuuuuuuuuuuuuugagauggagucucgcucugucucccaggguggaguacaguggcaugaucuuggcucacugcaaccuccaucuccuggguuccagugacucucccaccucagccucccgaguagcugggauuauaggugugggcugccacacccagcuaauuuuuuguguuuuuaguagagacgggguuucacuauguuggccaggcuggucgcgaacuccugaccuuguuauucacccgcuucggccucccaaagugcugggauuacaggugugagccaccgcgucuggccaguuuuuuauauuuuuaguagagacgagguuucaccacguuggucaggcuggucuugaaccccugaccucaagugauccacccgccuuggccucccaaaaugcugggauuacaggcgugagcaccgugcccagcuguaaauaaaguuuuguuggaacacagccacacuauuucuuaauguauuguguauaacugccuuugugcugcagcuacagaauugaguaguugugaggagaucauauaaccuguaaagucuaaaauauuuacagaauaaaugugccauuccugugcauugauuucccagugcugcuggaacaaguuaccacaaacuuaguaacuuaaaaaaucugguggcuuaaaacaacacaaauucuuuuacaguucuggaggcuagaagucuaaaaucaguuucaccgguuugaugucagaaguauaggcagagcagguuccuucugcaggcucuagggcaaaaucuguuuucuugccuuuucuagcuucuggaggcuacuugcauuccucgaauccuagcuccccuuucccaucauuccagucucuugauucguugucacauaugcuuccugugucaaaucucccucugccuugcucuuauggggacacuugugauuacauuuaggacucacccaaauaauucaauauaauuuccccaucucagugucuuuaacuuaaucacaucugcaaaguaccuuuugccauauaaagugcauuuaaggaucuagggaguaggacuuugaugucuuugggggcuguuguuuagcuuaccacaggcuucugucuggucccuaaagauuuacauccauccuacaugcaaaacacauucaccauauuguaaaaaucuuccaaaaucuaaacccauugcauuaacucaggucuaaaaucucguuaaauauuauaacucaaaagucccaaaucucauaaucuaaucaucuaacuccaguauaggugaguuucuggguaugauucaucccaagacagaauuccucuuuaucuauggaccugugaaacuagcaaacaaguuaugugcugcuaaaauacuguggugggacaggcauagaauaacaauuauauacauucccauucagaaagggagacaaugagaggaaagaaaagagucacuagcaccagacaauuuuuaaauuuaaucagguaaacuuuuagguuucaaggguugggaauagucccuguggcacccagcuccacucuaugggccagaggguuguguauguauuguguauggcuguuuuuauguuacagcaaccaaaucaagugguuaugggguagucauauagccugcaaagccugaaauauuuacuagauuguucccugucagaauguaugcuuguugagggcaggagucuuugugucuuuugcuugcuaaaguauccuaagugucuggaacagugucugacacuuaacagacacucauugaaaugcugaacuaaaagaaaaaaauuuaagcaauuuaauagagaugagagggcaaaacuuuugacauugcugaaguaguaacccuauuuauagauaaaacauuaaaaaagagaacuuuuaaaaacauagcuacguauuaaaauaaaucuacauauuaaaauagcauacuguauuccaauaaaaauuguaacagaaugacugacaccaacaugcaucuugguuaacuuguacuguggagagaaacaaguaauuuuuaagacuucuggcagaaaaagcuagucauuuaaaagugagaaaaacuaaguccgacuucagccauucauggcaguuuucagugucagaaaagaauggggacaguaucugcaaaguuuuaagaaacagaacaugugauacaagaauaauacagcuaagcgaauugucauucaaguacagggacaacaagcagacuuccacacuggaaagaauucagggaccauaacaccugugagcuuuucuugaaaaauaaaauuaagcauugaaguuauauuaaaucaaaagagugaauucuguaauagaggggcuacaggaaaugaauuaccagugagcauugaauguauucaauuauagaaguaggguuaaacuacuguagaaauuaugauuaaagauagaauguaaauguuauaauccaugauaauacaaaaagaauaauacuaacaaaaauuuggagauacacgggagggcagaugagagaggagaaagcuuacgugcauuaauuuuuuugcuuucauagcuuaacucuuuuaucuaaaguuuuauggcagcgacaaaaagaacuagaauguaaaucucccauauuucagagagaaaacacauucacuuaggaaaacaaaagacacucuuacaucuguauuguccaauaagauagccauuagauacauauggcuauuauagugaacauuaauugaacuuuuguaaaauugaaaauucaguucauuagucacacuagcuauauuucaagugcucauuagacacauuuagcuuguggcuacuaugcugaaugauggaacauuuuccaucauugaaaaaaguucuguuggauaacacugccuuauaggaaacaaagaaaguacuaaaaauagagauguaacacaaaacaaauucauagaauuaacaccagacauugccuauuaaaagaaauacagauuaguuuaaaaauaaaauacagcuaacuauaugcuacauauugugauguauauaaaacaaggcaaagcaaaauuugaauauaaaaggaggggugaaagcauauaaggcaaacacuacugaaaggaagcuugggugaagguauuaauaauuagaaaauugaauuaaaugcaaaaaguuuugaaggagacaagaaugagguacuuuauccaaaaugaggaggaacugucaugaauuauuuauuaauguaacaccaaaguacauaagccaaaaaucacaaaaaauguaaauagaaacaaaauaguaucagccuuuguuuuaaaaagaaggaaaaaccuaaggguaaaaaagauaugaauaauauacuugauacagauugauuaauacuuaugaaaaccuuaccuuuauaauagaaaagucaccuuuauaaguauucauggaacacuuacaaauuauucagcauucagccccugaaaaccuguuaauucuagaauguggaaauauaguagagacuuauucugucauuacaaugcaaucaaaugauacauuuauuuugagaagaaaaugaacagauaguacccagauaugucaaaauggaaaaauaaaaagaaaaccucaacuuuugggacaguauauaaguaaaaauugaaauuacagaauauuuuuaaaaucuaaugaugaaaaccuaugaguucaacuaaagcuauggucagaggaaaauucauaguccuuggcacuuaaauuacugaacgaguguauuguucagggcuccccauugcuggcaguagaaucuaguucauagauccucuuggaaauccggaaaaccaagcuugcaucugacagagccagaaagagugcaucagggaaaaaugcccacgcuacaaaauuuuuuaagugcaggacacuuccaaaaaaagucuuuuuuuuuuuuuuuuuuugagacagggucucacucugucacccagguuggaguacaguggugccaucucagcucacugcaaccucugccuccuggguucaagcaguccucccaccucaaccucccaaguagcugagacuacaggcacaccccacaacaccagucuaauuuuuguauuaucuguagagaugggguuuagucauguuucccaggcuggucuugcacuccugagcucaaguaauccucccaccuugaccucccaaagugcugggauuacagacaugagccaccacaccuggccaaauugcuuuccuaauugaaaaagaaaugaaggacuaucagucaaaacuucuuccucuugguuuccuaauggagggagucagaguuguagaccauuuuggauuaugugagaggaguugaggaaguggagagauugauagcaguaguauaaaugcauggggagcuaaagaagggaggguaaaagguuaaaaaccucuuuaaagcauggacauggaauuuuguagcuaguucacaccucugccuguuuuugaagcucagcagaaaggucugaagccauugauaauuuuagaaagccaugccaaagagagauaccucuugaguuaauuauuuuuguuaauuuauuuuuaaaaguuaugucuagucugaugggauuuuaggauuuggggguaugucagacuaggacgcuuuauaccauuguccuuaguuuaucuuuuaugcuaauuaucaguaucuaaaauuauggggaagggguuguuuuguuuacgugauuaucuuucuuccucccagaaugauaaguuccaugaaggcaaaggacuuuuugcuuuuuacuaauuuugcucauugcuuuauucuugaauuagaacagucuucuacgcaguagucuuagcacauauacaaagaauaugcuccauaaauauuuguugaauuaguagcugcauuaagauaauuaugggacaauuggaaauuggcuaggggugaacuccaugggagagauuuuaauugaucuuauguuaaccaauuugauuuuucuuagucugacuaaagacaugacuggaaaagaagauguauaccgaggcccggccaucagagcucucugcaggaucaccgauguaaguuaucuguuucacugaguuaccaaauggaacacuauguuuaucugcagguggccauguagauuuaguaggauuuccuagucugacuuugugaauuuucaguauaagagaaacaugaucaccagaaaggcuuuuguggcuccaggcuuucuuuugucuucagauuuuuuuccuuuauuuauguuaguccauuuucucucuuuauuugcccccuugaacuguuguagugaggguacauugcuugcaggaaacaaaaacccauucaaauuuaucuuaaaaagcuuuauuauaggacacaaaucucagaauuugaggugaagcuuauagguagacaccagggcaagaaauugggcagcuuuaagaauucaacagcagauuuuuuuucuuuuucuuuuuugagucagagucucgugcuuucgcccaggcuggagugcaguggcacgaucuuggcucacugcaaccuccgccucccggguucaaguaauucuccugccucagccuccugaguagcugggauuugaggcacccaccaccacaccuggcuaauuuuuuuuuuuguagcaguuugaacaaacugaaaacuuuauucuucugugugagcugaacucaaguuucagaauaaucaucgccaugugggaggcuuuuuguuaaaaugcagaagaaaucucaaaauacuguauuuauaucugccuuccacugcugccaauauaguaagcaucuccuacacaaucaacaauaaacagcaaaugaugcaguucauagaguauuuugcacuuggaaaaaaauauauaucugaauuguaaaaagaaguguuuggauuuuguaugucuuuuuuauuauuguuaaaauacuaaaugaaacuucucagccuggcaucuuuuccucuaucucaauagcuuauccuagagccagaaaaagccuugaggagacaaugucuucuggcuuccagauaaaacuuauccaaauuuuuuggcaacucaucccuaaugauuuuaaaauuugaaaaggcuugucuuuuugucuauccuuaaaagcaauaucaaguauuauguccuaagggggaucuaaggagugggggaaauuuauuguuccuccucaccacaguacaguccacaaccacuggcuggcccacagguggcucagcacuucccuagucagggugucccaccucuaggaaagcgccagcacugaaggucacccagugucauucuuuguaugcaguacacucuuggccaccaaacaguauugugaaauacagaucauucagccgcuaccaccaucacuacuccuacagggcacaagaaagcaaucuccaaucucuuuuauaaauaaacaguccuaacuucuaggcucagagaugauagauaaaacuuagcuguugcaauuauauaauucccugacaugaaauuuuauuggauuuaauaucuacaugauauagccauuuaagaguauaacuugaggaaaaaggaaagaucuaccugaucaaaaaacuuguugggguggccuaucagaaucuuaaacuuccccuuuagcaucuauaacgaagacauagaugaagugcauucauuccauaauuacugagcuccuauuauaugccaggcacugagcaccugcucaucagcucauugacaauagccaugcucaagauccacacuccucauauaacuuucugauuauaauugaucuucccagauaagauuuccccaacaggagcgauaauccaguucacuugguggcuauaaguauaaaagaaugcacuggcauucuguuauguacauaacuuccuaugaguuugauuuaaugugacaaaacaugaauaccuuugugugaacugacaaaauccacuucuagaacugcaaagccaaggaccguauccaugaccuucaugcuacaccaacuuggagccauccuuuuugacuucucucauaacucacuucuauuccaagaacaacaagucuuccuccuuacuuccuaggacauuugcuuuggugucucaaaauaauggauagucagggacauuggaguuuggauaugccuauauuaagaagucuuccaagugggguaaaugaagauuuuccuaggguaugguaagacugcaaggaauacccaggcaauauccucaaaucugucugaggagaguuuuaaaggaauaaauuuccagaucuucaacuucccuaugaaauauuuucuaaaaccaggccgaugcccagcuaauuuuuguauuuuuaguagaaacaggguuucaccauguuggccaggcuauucacuguggugauccaucauguacuagacacaggcccucuuauugaaacauuuaagagagagaaucugauuagucagcaauaggccaguagcuuauauccaccugugucugagucagguguuuaacauugauccaguucauuauaucuggagggaugagaucauguaguauguuaggcugucucuuucugggaacucugaguaggaaggguaggccaggcauuaccaagcaaauugaauaauagcuauauacccaugcuuggguauauuuuagguguauguuuguaaccuucuuaaguuguaaagguugagcaggaccaaauuauacaucugauaaaucuggauucuagaaggaguaauagaaaugcuuuaauauuuuuuggugcacuguuguucuguugugauuguuuuuuauuuuuugcauuacauugguagcagcgugagacuugaccaugcuagugcuagcaauaaaacucuuuuuuucaucugaauauugcucucagucuuuuuacucaucuuuaucugccaccaccuucccagugcuuuuucccaguuaaaguuaaaaagaacuguauuuccagaggauuuuauguugagggcucacuauaguaguacacuacacauuuaauucuuuauguaucucagauaaucagggauuacguuugauuucuaggacucucugggaucuguauauaauaugugcccuucacauagaggaaucuucauaacuucaaaagcaggcuccaucuccauauaggaauuucuuuaugacuuuccugauggguucagccucugcuuguguauuucuuccaaacugagauucuccauuuugagacaguuuauuucauuguugaacaguuauucuucuuuauauauaaucuuaaauguucuuucuuaaagcuucaacuucguuguuuggguucugcccuuugggauauuauuacuauauuaucauccuuuuagugcauucugaauauuugcacagaaacaaauauaagauugguuuuugaaaauuauuuugaagcauaagaguaauuuugcauaagcauguuuuuccuuaacaauuuuuucuuuuugaauguuauuagggaacaauguugcaagccauugaaagauacaugaagcaggccauuguggauaaaguuuccaguguauccaguucagcacugguaucuucccugguaagugaacaagcagcuuccuaguucuuaagcaugguacaguuuugaguugcgaaaacaaaguaucacuaugauugucucacaaaugaaacaguuaaaaauauguauacaccucuauuacuuuauccaaguguguuuuaucuagagcagggguccccaccccagggcuucagaccaguacuggucugugaccugucaggaacugggcugcacagcagguggugaguggcaggcaagcgagcauugcugccugagcuccgccuccugccagaccagcagcagugugagauucucauaggagcucgaacccuauugugagcugcgcaugcagggaucuagguugccggccucauaugagaaucuaaugccuaaugaucugagguggaacaguuucauccaaaaacuaucccucugcccucuguccaugggaaaauugucuuccauaaaaccaaucccuggugccaaaaagguuggagauugcugaucuauaggaucauugagcaauuaaaaacauaaaauguucguauguuugaaagguuuuggaaaucugaaaguuauguuguacacauaauaaaagagggguaagugugggguaugggacaggaaagaaaccuaggacccuuuucuuucauuuaaaaucuucuuuaugaccugccuuuaugacuucuacuacuugucucuuuguccucugcuuuuucuggugcccuuugucuacguguauccuucaauccaaaguuuccugucccacuucugaauuuccucccaggaaguggucuuuuuuuuaguaauacauuuuucuuuccguuuuucagcagaacacaauuuauacauuaaaaccuaucacauugcauuugauuaacgucaguuaccuauaugugaauguguaagacaucuaaauacaagaguuccugauucuggaauauaauuggcugaguuuuauagcagagaauauacuaguacucucuuucuuccaggggaguuuccuggaaguaaagcuuguuaugauaacguuauuuaagcaccguucuguugacuguccaucccuauccuguucuuccucuuucauuacuuccuuuuacacaccucucccagcuuacauauacucaccuuuguaacagguaugggagaaaauacuucugguuuaucaguugcuccaggaguaaagacacaaaauagacuuauaagagcuacauaguuuucuuccucuugggaaaugucugugauuuucaaagaaaacuaacucauguuucuaagcuucuagugaccaagcauuauuuauucucauuuuuuuuuuucuguauuuagcacaugaugaagauaagcuaugaugugguuaagcgcuggaucaaugaagcccaagaagcugcaucaagugauaauauuaugguccagguauugucauugaaucacauuagcuugucucaggaucagcauucuuuaaaccuguauuguaggggcaguguauugauucccuagauaaacauuaacuaaaggcaaauuaagcagcuacuaguacguauucugaaguaggaaucucacuaauuaugauuacugccauuugaauacugcccuucagguguuucauagaagcuagaugacccuuuguaggaauauuugggaaagauuguuauauucaguaguagauugagaugcucguggcagucuuuuauuugaaaaauaauuuguguaaaaagauaauuccaaguucugaggccuugauuauaggcauuauaaaaaucauacggagcagcuuuuacuuuaugaaacuuugaaaccauuuugucaaaaagagcucuuuugauauuuauuagguuauucuuaagaggaauaagauuaaauucuucacuggaaauuguguguaaaguaccccauuuuauuugagagggcguuuaugcccucuugauguuuauaacuucuaugguaacauauucaguuauuaggaaacagaguagucauuuuucccuugggaaacacucucauucuccugacucugaucauguguuuuuauacaaagugucaagaugaugacacucuuguagccugcuuuaggagauuaauccuuuaauuacuaagauggccacagaugauguaaagccacucguagagacagauagcaccaguaaagcccuggacccgagagcguguguacugaggaugugugagccaguguugagccugcuagagccaucuucagguuguaugucaccuccuuuaugccugccagucugaauugacagcuucuagggguaaauuagaaacguuuaaucuuuucagucuugccuguguuuaguucagugugaaaaaaauauuuguguacaugugaccuggguauuuuaaagaaaucuuuaaucuaguuccguguaauucuauuuuuguguaaauauuuugacaucuuucuaauccaugugcuaccuucuuuuucauguucuuuaguaccaugcauugggaguccuguaucaccuuagaaagaaugaucgacuugcuguuuccaagauguugaauaaguuuacuaaaucuggucucaagucacaguuugcuuacugcaugcugauccgaauugccagucgcuuacuaaaagaaacugaggauggguaagugucuucaccuaaaccuggguuauuuuccauuugcgaaguuaauauaccuuagaguuuauuuccuuuuugaauuuuuuuuggggcagugcuaacuuuacagaugaguucaauguuuuucaauuuuuuaaaaaaauuauggaauuucaagucacacuuuuuuuaaccuuacuguaugcucuuguauauguacuuaauuauuaauagcacauuaacaaacugauauugaacaaaaaauauaugcauugaucauaagauauauagauaauuaaauaugaaaguuggcagggacauuaagaauuauccuaucccuuuuauuuuuauaaaagagaauguugaaguacugcauuuagugauuugccuaagaucauuccacaagucugaggcacauaagaugugaccaaauauacuuuagcagucuuucgaaggcuagggaagggcaggaaugagaaaucuuuugagguauaguaagcugggcauggaucuagggagcaaagaagaccccuuccccagccugaaggcuuauggcugagcucuaaaacaaagauuucuuauguggccuggcaaacugagguguaacacagagaaagaucucuagaaucugccacuacuacuaaugcccugcugaaaggggaaaccugaucuguuccucagaucauuuguaaacagcagauaacugaauuuaauuaaagcugcagcaaaguccugacccagaucaacuauuagcugcuaaaaaugaaaaaggaccugcacuuuucuaaugauaaguauuaguuacaucagugucuacugcaccuuuauaagcagugucuagcaaacaaucaaaaaauacagaggcagugacauguaacccauaaacaagagggaaaaaaauagucaguagaagcugacuuacagaugacccacauauagaaauuaggaggcagugacuuuagaaauuacuaggcagugacuuuuaaacaacuucucuaaagugaacaccaaaggaguuuuguaaagugaacuuuuguaacuuuuguaaauuacaucuuuccacuaaagaguggaaaagauggacaaaauguguaaauggguaaggaauucaauagauaaauagaaacuagaaaaaaaaucuugaaccaaaaaauacaauaucaaaaauaaaaauuuauuugaagcacuuaauagcagauuggacacaguggaaaaaagauuagagaacuuaaagacaagucaauagaaauuguccaaacugaagcauagggagaaaaauaagaaaagaaaauaaaagaauagaacaucugaagccuagggaauauaucaaaaagucuaauacuuguguaaugagucucagaaggaaaggaaacagaauggaauagaauaaaucuuugaagagauaauggauauguuaguccauuuucaugcugcugauaaagacauacccgagacugggcaauuuacaaaaggaagaaguuuaauggacuuacaauuccacguggcuggggaagccucacaaucaugguggaaggcaaggaggaacaagucacgucuugaauggauggcagcaggcaaagagagagagcgcuugugcagggaaacucccauuuuuaaaaccaucagaucucaugagacuuacugucaugagaacagcaugggaaacacuugcccccaugauucaauuaccucccacuuggucccucccauaacacauggaaauucaagaugagauuuggguggggacacaggcaaaccauaucaauggaugagaauuuuccaaaaugaaugaaaggggcugggugcgguggcucauggcuguaauccuagcacuuugggaggcugaggcaggugaaucgcuugagcucaggaguucaagacaagccugggcaacaugacaaaaccccaucucuaucagaagaaaauacaaaaauuagccaggcauggugacgcaggccuguggucccagcuacucaggaggcugaggugggaggaucgguugagcaugggaggcugggaggcagagguuacagugaccugagaugacaccacugcacuccaacccgggugacagagugagauccccaucucaaaaaauaacaacaacaaacccaaaaugaauccaagauggccagugacacucaaguaggauaaauaaaaaccacaccuaaucauaaccuagucauauauauuacaaguaaaaaguugaaaaccaaaagagaaagaaugaaagaaaagcuugaaagucgccuuuuuuuaaaaaaaagacaaauuagauucauuagauucagggaaacaaaaauaagaaucguugacuucucauuagaaaaauggauacgagaggauaauggacaucuuaaaauuguugaaacaaauaacugaaaaucuggaguucuauacucuaaaaguauucuuccaaaugaaggugaaauuaaaacauuuucaaccaggaaaaaacaaaaacccgaaaggauuugugucugcauaccugcaucaugaaggaugcuaaaaggaguuuuuccagcuaaaaagaaaugauaguagauggaugccaggaucuucaggaggaaugaaggacaagagaaaggguaaauguguagguaaauuaaaagguaaauauguagguaaauuauaaauauauacaauuuuuacuaaaaccagcagcaaauuauggggcuuauauauauguagaagugaaauauaugaaaauaguaguauaaagggcaugagggagaaaaauggacauuuguaaaguuuuuguaucaugcaguaguauauuauuugaugauacacugugauaaggaugaauauuguaaucucuugaggaugaauauuauaacuaacaaaaaaaucuuuguaaaacauauagaucuuaaaugucaacagagaagauaaaauggaauauuuaaaaauauucaguugagcuuccuccuuccaauaaugguguagcuuggccagcuuaauccuccugcaaauaauaauugacauuaguacaaagcuauaccuucccaaaaugaagauaacccacaacaguaugaaaauauuggggaguggugaaaagcaagcaaaaacuggagggaagcaguugaugccugaaagacaaaagcuauacugggugaaauuugugggguuuuuuugcuauucuccugagggcauucuguaauuccucaguguaggaugacagaaagcuacaguauuucuggacagaguggucaaaacaguuugagguuggaagaguaacugaaaacuuagaguggaaaaccuggaaaagagggagccauaaaaggaaugagucucaaaaugaauuuuaaacucuacaaaaaucacuggcugaccaacugaacuacauauauacaggagaauacucuaggagaccugccaaaagcaguaguuguaagauaaaagaauugaauggagaauucagcugcaacucacuauggaggaaauaaaguuuggaguuugaucccagccaagcuucuugcuaaagaaacuccaugaguucuagagucuuuacaguauaucauuacaauguuuaauagaugguaaaaauugccagaaguacaaagaauuuggaaaaugugacuaguagccaagagaaaaagcaaucaauagaaacuaacccugauaugauccagacguuggaauuagcaaacaaaaacuuuguagcaucuauuauaaauuuguccaugacuuuauuuauuuauuuauuuauuuauuuauuuauuuaugacagucucucucacucuguugugaagccuggacugcaguggcgugauccuggcucacugcaaccucugccuuccacguucaagcaauccucucaccucagccucccaaguagcugggacuacagggaugcaccaccacaccuggcuaauuuuuguacuuuuuguagagaugggguuccgcaguguugcccaggccggucucaaacuccugagcucaagcaaucaaucugccucagccucccaaagugcugguauuauaggugugcaccaccacagccagccuuguccaugacuuuaauggaaaauaguuaccaugaaugaacaggggaaauggaaacgacaaaaagagcuaaguagaaauucuagagcuuaaaaauacucugucaggauucaaccagagaaguagaaccuggaggauauaaauauguagagauuuguuuauugauuauguaauucgggggccagcuaagcaaaucuaaaauucauaggauaggcugucaggaagggaagauugcagggaggcuggaacucaggggcacaggccaaaguugcucuccguaggugaaauuugucauuucacauuuuacuguaaacagcaagauaaaacugggucacaucuucauuuuuggaauuuuccucaaguaaauauccaacuucaucguuuacaaguucugcuucacaaauaacuacagggcacaaauucacuaagcucucugccaauacauaauaacaaggaucuaccuuacucaaguuuacauuaauguguuuuuuacuuccuucugagcccucacuacagcaucuuuuaaguccagauuucuguaggcaguucauaagcccugaccagcaguguccuuaagaaccagaucgauugaucuuucuuucuccuuccuuccuuccuucuuccuuccuucuuucucuuucuuuucucuuucuuucuuuucuuucucucucucuuucuuuuucuuucucuuucucuuucuuucucucucucucucucucucuuucuuuuuuuuauuuauuuuaaagucuugcucugcugcccaggcuggaguacaguggcacagucucagcucacuacaaccuccgcuuccuggguucaagccauucauaugccucagccucuugaguagcuggaacuauaggcaucccagcacuuugggaggcugagguggguggaucauuuaagaucagauuucuuauaagucucuucaaaacuaggcuuccuccaucaugcuccucaaaauucuuccaagcuuccacccagugccuaauuccagucaguucuacaauuugagguauuugucgcaguaacacuucacuuacagguaccaaaaucuguuaguuuuuuuuauuguugccauaacaaauuaccauuaaauguaauggcuuacaacaagauccauuuauuaucucagaucuguagauuagaagucugacacaggccucauggggcuaaagugaagauguugguggagugcuguugcuuacuggaggcuuugaggaagaauccacuuccaaucucauuuaagucguuggccaaauucauuuccuugagacuguagguuguaggucucuguuuccuugcuggcuuucagcuggagguuagucugugccucuagagguugccuguauuccuucucaugcuuucaaugagcaacuaaaggccucucuuugagucccuugcauguugauucauacgugucagagccagcaauaguguguugagcugcacuuugaaucucucugauuugccuuucugccacauuucuucugccuccucuuucagcacaucugcuuuaaagugcucaugugauuagauugcaccuaccuggguaauuuaggugacaaucuuaauuauaucagcacaguuccuuugccauguuguaacguaacauauucaucaguucuaggaaugaagacauagacaucuuuggggagccauucugccccagcaagugcaauaacugaaucagauaauuugcugaauggacuuaacagcagauuagagauggcugaugagagagucaaagagaguuagugaauuugaagauagagcaggagaaaguagcuaguuugaagaacagagagaaaacagauuaaagaaaauaaagagccucgaagaacugugggauaagaucaaguggccuaacacauauguaauuggaaucuggaagcaaaggugauagaauggagcaaaaaagauauaugaagaaauaaugaccaaauauuucccaguauggguuuauucuaguaguauaagguugaucuaacaguaaaacauagcauaauauaccucauuuuaaaaauacagaagagucuuaaugccuuaaugggugcagaaaaaagcgguugauaaaauuuaauggcaauucaugauugaaaucucugccaccaggacuggaagggaacaugauuauucugacaacaguacaaaaaaacuccacuaaacuuuauacuuauugguggacuauuaaaagcuuuccccuagagauugugaaugagacagacaaaaaugccugcuauuuuuauuuuuuaaauaguauuuugcuagaaggcuuacuuugugcaauaagugaagaaaauaaaauaccuaaaaauuugaaaggaggacguaacacuauauuuggagauaauauggcuauauauauaggaaaugcaaaauaaacuguacauuaucuauuagagcucauauguaaauuuaccaguguugcuggucaauauccgaagucauuuuauuucuuauuccagcaacccaucaaaaagauaaaauuuuguaaaaaugguacaauuuauaauuauauugaaaucaaauccuugggaauguaucuacuaaaauuuguguauaucucuacacagaaaauuacacaauauuaaaguaugaccuaaguaaaugaggcauauaacauuuauggaauauucaauauuguaaagauacaucuucuuaaauugaccuauggauuccacaaaccccuaauuacaaucccaauuggcuucuuauaaauaaccaaacagaaaugccuacauuuguguguuaaaagacauacaguugauccuugaacaacauggguuugaacugcauggguccacuuacacauggauuuucuuccaccucugccacccuugagacaucaagaccuccucuuccaccccagccuacucaauguaagaugaugaggaugaagaccuuuaugaugauccacuuucacuuaaugaauaguuauaucuucucuuccuuaugauuuucuuaauauuuucuuuucucuagcuuacuuuauuguaagaauacaauauauauuacauauaacauaaaacguguuaaugaacuauuuuuguuaucaacaagaugauuaauaguagguuauuagugauauuuugggggagucaaaaguuacaugugaauuugcagcuacauggggguuggcacuguuaaccccauguuguucgaggaucaacuguacaagaugccuauaguacuguuauucauaauugccgcaaauuuuuuuuuuuuuuuuuuuuuuuuugagacugaguuuugcuccuguugcccaggccagaguguaauggugccaucuuggcucacugcaaccucugccucccggguucaauugauucuccugccucagccuccccaguagcugagauugcaggcacgcaccaccacacccugcuaauuuuuuguauuuuuaguagagacggagugugaccauguucgccaggcuggucuugaacuucugaccucaggugauccaccugccucggccucccaaagugcugggauuacaggcaugagccaccaugcccaaauugccacaaaauggaagcaguccaaaugucuaucagugccagaaucaaaaaauaaauugugguauauucauauagucagauaguauacaauaauggaaaugaacaauuacuguuaaauacaaucacauaaauacaucucaccaagaagucauacacaaaugaauacauuuuauauaguuccauuuauguuuauuuuagacuuaacauaggcacaacuaaccugugguauugaaaguuaguauagugauuaucucugagguaggagcacauuaauuuuguaguaauucacguaugauuuucauacugucauguguaacaccagauuaaagggauaguaaauauuuauuuuuccauauaauuuuugcaggucagggguuugggaaugucuuagcuggaugguucuuauuugggguagaaaaguugauaauucugaauugauguuuacaaauaauuuuuuuuaaauuagaagcucuaaaauuccagaggaugacaacaugagaaauaaugguguagaaggugguauuaguuuauggccauaccaccuuaaacaagccaggucucaucugaucuuggaagcuaagcaagguugggccugguuaguacuuggaugcgagacaaucugguaauaccggaugcuguaggcuuuaaaaaaaaaggaaagugguuggccgggugugguggcucaugccuguagucccagcacuuugggaggccgaggcaggaggaucacuugaggucaggaguucgagaccagccuggccaauauggugaaacccccgucucuacuaaaaauacaaaaauuagcugggugugauggugugugccuguaaucccagcuauucaggaggcugagcaggagaauugcuugaacccaggaggcagagguugcagugaccugagacugugccacuauacuccaaccugggcaacagagugagacuuugucucaaaaaaaguaaaaaaaggaaggugguauuagauggaaguaaaaguaugcuguguauguguguugucaucuuguaugggaggaaaauaugguaauaauauaaaacuuuauuguaauauuauagauauagcuaauauaauauuuaauuauauaaagaauguaaauugaauguaaagcuuucaaaaugucgaagaaaauggagugaggaaaaguugauugaaaauugauaaggaaaaaauugauugagguaaagccuucaaauagacaacaggaaagaaaucgguuagaaguaaguguaacuguauguguuaucucuugcuaugugguauauuggaccaaaaauucacagcuuauaaguaauacuuacuauucccuaguugcuauggucagggaucugagagaaucuguccaguuugauucaaggucccucccucguaugaguuuauaaucaagucguuggccuagccugcagucaucugggccuggaggauccacguaauuuuacuuauauaguuguugacaagccucaguuucucccuggcuguuggccagaugcuuuaguuucucacuuugagagccuucccuccuuccuuccuuccuccuucuuugcuuccuuccuuccuucuuugcuuccuuccuuccuucccuccuuccuuccuuccuuuuuuuauuauacuuuaaguucugggguacaugugcagaauguguagaacgugcaguuuuguugcauagguauacaugugccauggugguuugcugcacccaucaaccugucaucuacauuagguauuucuccuaacgcuaucccuccccuggcuucccacccgcgacaggccccggugugugauguuccucuccuuguguccauggguucucauuguucaacucccacuuaugagugagaacaugugcgguauuugguuuucuguucuuguguuaguuuguugagaaugaugguuuccaguuucauccgugucccugcaaaggacaugaacucauccuuuuuuauggcugcauaguauuacaugguguauaugugccacauuaucuuuacccagucuaucauugaugggcauuuggguugguuccaagucuuugcuauugugaauagugccacaauaaacauacgugugcaugugucuuuagaguagaaugauuuauaauccuuuggguauauacccaguaaugggauugcugggucaaaugguauuucugguuuaaauccuugaggaauugccacacugucuuccacaaugguugaacuaauuuacacucccaacaguguaaaagaguuccuauuucuccacauccucuccagcaucuguuguuuccugacuuuuuaaugauugccauucugagugccgugagaugguaucucauugugguuuugauuugcguuucucuaaugaccagugaugaugagcuuuuuuccugccugaauguucucacagcauggcagcuggcuucucccaaagcaagggaauugagagaaagagugagccugauauggaaguugcaguguuuuauaaccgaaucucaaaagugacaggccaucaccucucauguauuccuuuggucacacagacaaacucugguguauauaaugucuacacaaggauguggaauuguagaaguggauauuuuggggggccaucuuggaggcuggcuagaacacaaaauauaacauuuaucauaaugaauguaauugaauuuacauauuaaaagaggcucagauuggguaaacaaaaugaaacaagagaccuuuaugccuuuagaaaagacacaaacaaaaugacaggaaacauugaaaauaaauauauaaaaaauguauacuaacuauacacucacacacauaaaaaaugcaauguagcaauauuaauauaagccaaaauaggaaucaguguguagugcacuaaaaaugacaaaaugggccaggcauaguggcucacgccuguaauccuagcacuuugggaggccaaggugaguggauugccugagcccaggaguucgagaccagccugggcaacauggaaaaacccugucucuacuaaaaauacaaaaaaauuagccaggcgugguggcacguuccuguagucccagcuacuugggagguuaaggcacgagaaucucuugaacccaggaggcggagguugcggugagccaagauugugccacaacacuccagccugggugauagcgucucugucucaaaaaauaaauaaauaaauaaaaaugacaaaauggaauuuuguauuuugacaaaaguaauggucuaaaaaaauauaacaggaaugaacuuguauaugcuuaauauuaacaauauauaguuucaaaauaugcacaucaaaaucuuaauacaggaaacuaaguccucuugaucucuucauggagacuuuaacacaacugucucagaaacugagaaaucaaguauaaaaauguaagacuguaacugauuuguauguuacugauaacaaaauugaccuccuauuuagaacccugcaucuaagagagaauauacaguauuaauucuuucuaaaauuuuaaagugaaaacuguacuuauagaaaacugcauaaaacauaauaguuguguguccaauauauacaguugcuaugaaacacccuuauaaugaccacauguauuaggaaguagcacauuucuuuguaccccagaaaugcuuuauauauccuccuugaucaugauuauuuacccccagagcaaauuacuauccuaauuucauaucaaauuuuuccuggguaugcaucccuaaacaguaaaguuuaguuuugccuuguuuugaaugcucugucaauagaaucauguuauauuuugugucuucuuuuuuuuuucuucuagugaaaguauagagauuuacugcaaagagaaauguacaaacucaagaaaggggagugugggcauacucaagagagaguuccauacaagggggguuuggggcugcuaccuuuauggguugcuuuaacuaagggguagaauauuuaugaaaaucucuaggaaaagguggcgaugucucugaacuguagugccacccacucauacgcaaugcggguguucuuggaacugucauggcaccaaugggugugugacuuaguauguuaaugagcauauaaugagguccuaggugaaaucuaggucaaauccagugccauauugggucugguuggucuuagccagcucuguucacauguuguucacuuaccagcccauagccucuagucaugugaaacugcugccuggaguuuucuauacucaggugaccacccaguauuauuccugucucauuuuaucccccucagagacuuccaucccuuauucuuaaggguugaugagggaggaggacaguuuucuauaucugcuuccugcugauuuaggggcauuggcccugccuggcaccagcauggaaaccucuggcugccugcucuaagggucccaagggugggucaucagaagagucugcaucugaggcagggauugcuuggaauccuugcaugaccaucauuuugacguggaacuuugcaaccuagaagacauaacuuuacaaagagguuaaacaagcaaggacuaaaaaccaauaauaagaggauagcuacuagaaguccuagggaagguaggaaccaugucacacuagguagguagccuuugauggggucccagauggcuugcaugauagaguuauugaaauuauuuagcuggauagcccguugguaaaucuuuugaacuuguaguucagcuaauacugaacuguuaguauaagaacagaagauggggcuuauugcagcgcaagccccuccgagcaguugaugcuuuggcccaguuagggccucaugcaguggcuuaguaaugagcugaaauccugggauccaaaucgugccauaccuaggaaaguuaugaguugcuucuucauuugugaaggucucgucuuuaagauagccuccuauuguuugacagacaagauccgguuuccugggcuuaggauguaucccagauauuuuauuuccauuuuagaaaucugggccuuagauggagagaccugauaaucuucuuucucccaggaaguuuaggacuugaaugguauucuuaucugaguucucuuuaguggaacuauauacaaggaugucauccacaucuuggaguacggcuucccuuucuaccucuagcucccuuaauucucaugccgaggcauugcugaacaaguaagggcuaucccuaaagcccugaggcaguacugugcagguguacugcuggguaauaauaguuucaggauuaguccacucaaaagcaaacaaauauugagagucagugugcagagggauacaaaaaaaaaagcauccuugagaucuuauaccaugaaccagcccuugcucuaaugucccagcuuccuacacuagaagcggcaaccauuuccuacagguuugcuguuagggcuguuugguccuugggcgaagaaucccccugggugucauuugggccugcugucugucccauuguuugccaugcugaguccuuucagccucuucagcccuaucccuauuauugaauaaccuaaaagcuacaugaaacaugugaguaauaggcauuugggaucccaaagccaauuucugcacuuuccuccucauguuccuccugaugucagaugcugauagacuaauaaaguauguccuuagaaaaauuuggccagcaucaauauuggguucaauguuagcauauauuuuuuagggccuucacaaggcuccccuggaacacagcaggguuuucaucuuuucuuugaguuauuucccuuauuuuauuauagcucacaggcuuagugguaccuuuuuuucauuccuuucacuaaacaagucaucaugugauuuuuuuuuuucuuagauaagccuggcccuguugauaauuccaauuagggccacuguuaggcacagacauggccuuuacaguauauuguucggggucccaagccaacaaggugucagcauaagccugggccugugcccaaauacacugcuuuuccucagggguacaacacauggacaagauaauaugaauauguccccagguuaacucagaugagagugagagagcccagaaccccuccauaacuuuaguuagguccucugaaaauuggcccaaccucugucugcaguaggcuagaucagacaucgaaaaagauacacccagauagucccagcacccccacuggccaccucccuaagugggcauaacuuagaauggucaagaauguaggaaaugcacugugggcaacccuagcagggcucugcuccuucuguagagaagggugugaagguugguaaggagauggacuagcaggagucuggggguacauuucccaaaagggggaucgugcagguuaucuggugucccauuugguuccccuaaagggcugugagccuaacaaaggcagcaguucccgcgagggucaagguucugauaaagagccgugaaggcuuguauuaauacauaugcuacuucaguccacuucuucugauguuuacaaaaaagauuuaauuccaagaugguauugcauuuuacgguccuagacucuggccauugcaccccauuuucuaaaagagaguuacccauagccuugacuuguccucggcacgaccugaaagagaaaagaacaguauaguuuccucuucggagggacuaguuccagcauuuacaaaaugccaggugaaugagcuggugguucuaauguggcuguggaugcucugggcuagguggccauaaagaugauacugguggacugcaguggaguccccagaugccaaugggaccucagccccagccaguguccaggcucuugacaccagcuccauggucaggccggggagacaguuguccauguucccuuggcuggcugccuugguguccaggugucccuggagcccuaguguugcccaggcguccauggccccuggggcuuugcuuucaagguugaguaggaugaguguggaccuaguuugaaagcagcaagccugccaaaauccaucugaauauuuauuaccaaguaaaacuucguaguagagauaauucagcauggccaaauaauagccaccuugaagggcccccuuaaaacaauaggccuagauuuggcauuccagcggaccuauuuugcuguguccagaguucacuaaacuuuugugugaaguaugaggaagaagcaugagaagagaaaaccacaaaagcaggguuuaaagagagaugggaaagggaaaacaguucccaaccaaggucagugucuuagcgcagcuggucccuugggagaacagaagacuucccaggaauaagucauaaugcuccuuggcagcuguccagccacugggacaugggauuuuacccuacucacccucauuagccucuugcccaggaggcccauggcaccucagagcucagguguaggucaaagccuucccaccuccauuugucacugucagggcgaacugcguuuuccagcuggaggaagcagaggcacuacggcugaggggagucaggcuguaggaacaaggaagaaaguagcaguaacuccagagaacgagaagacuccaauuaaggccccaaugggacuuaccaacugcuggugguucuaauguggcugaugaugcucugggcuggauggccauaaagaugauacugguaggcuggagggggggguccccaaaugccgaugggaccucagcgccagccgguguccagacucuugacaccaucaugagaaggaauucaaggaugagucagaaaauagugaaaguacagagauuuuauuucaaagcaaaaagugcacacucaagggaguguggggguacucaagagaguugcaucuuguuuuguucauuuaguauuuucuucuaagauuucacccuuguuuuugcuuauagcuuuuguucacuuaaauucuauuuuauauuuccuugauaauuucccagcuuauaacuuuugagauguaacucauaaaccauaaaacucaccuuuuaaaaguauauaguuaauuuuuaguauauucacaaaacuauguaaccaccaccacuaauuccagaccauuugcaucaccucacaaagaaagcacccaacccauuaacagucacucugcauucuccuuuucccucucgcccuggaaaauacaaauccauuuuuuugucucuggauuugccuguucuggacaucucauauaaauggaaucacacaauauguggccuuuuguuucuggcuucuuucauuuaguauaauguuuucaagauucguuuauauuguagaaguuaucaguacuucucuuuauggcugaauaauauuacauuguauaaauauaccguauuuuauuuauccauucaucuguugauggacauuuggcucguauucauuuuuuggcuauuaaugaauaaugcugcuauaaauggucauguguaauuuuuuaugugacaauacauuucaguucuuugggguacauaccuaggaucagaacugcuaggucauaauauaacucugugucuagcuuuuugaggaacugccaaacuguuuuccaagggggcugcaccauuuuccauuuuaucaguaguguuugagagcccaauuucuccacauccucaccaacacuugucauugucugucuuuuuuauuauacccaccccaguagguguaaagagguugugugaaucuaguugugguuuugauuugcauuacccuagugaucagugauguugaacaucuuuucauguguuuauugccaaucuccauaucuucuuuggagagaugccuauuuaaaaucuuugcccauuuaaaaaauuagguugucuuuuauuguugaauuguauuaguucuuuguauauguuggauacuaaacccuuaucagauacauaauuuauaaauguuuccuccaauucuuugggucaucucuucacuuucuugauauaguguucuuucaaacacagaaguuuuacauuuugauaaagucuaauuuuucuguguuuuguuugcuugugcuuuugguauuaccccuaagaaaccauugccuaauucaaggucacaaagauuuacaccuguuuucuucaaagaguuuauuauaguuuuacauuuuacauuugggucuuugauccauuuugagaucauuuuuguguaugcugugggauagagauucaacuuaauucuuugcauguggcuauccaguugucucagcaccguuucaugaaaaacgauuuguucuccauugaauugucuuggugugcuugucaaagaauugugauuuuaauuucuaauuuccuaauuacuaaugaguuugacaacuuuuuucuguguuuacuauccauuuggauauccuuucuauugaaauauuuguuugaguuuuacccaguuuuuaacuugguuuucugcuuuguucccauugauuuucuaggaguucuuuaugucuucuaaaugugaguccgauguugauuguauguguugcaaguagcuuuucccauacucuagcuugucucuucccuuucuuggugucuuuugaugaacagagcuccguaaguguaagguagucacauuuaucagucuuuuacuuuagaaauaauguguuuggugucuugcauaagaaacauuuucuuaccccaaauucacaaauauauccucuguacuauuuuccauaagcauuauagcuucaacuuucauauuuuagguuuguaaucuaccuggaauuguuucauuuuuuuuuucuuuuuuggauauaguauaagguagcaauuuaauuuauuucuucuccauaugaaaacccaauaaucucagcaccauuaguugaaauaugugucuauacccacuacugugcaauauuagcuuuguuauaaaucaggugucuuuauguggauuggucuauuucuggacucauauucaccacugcuuuuuauuucuguuuaugugccagcaacacuccaccuuauuauaauagcuuucuuuauguuaguguagauguaugcuagagaaaaucuuccucccuuacuuuucuguaagaguauuuuccagcucuuguuuugcaucauuacuucucugugugugucuauauaauuucaucagggauuacuuaaccuucccuucaguggaguuugccucuuccuaggagauucucaccaaggccauuaauaacaaccaaggaguuccaaccuggccagucuuauuuuccagauauuuuauucauugggacuuuagggcuauuucccaguugcaguuagugauuagccauccugaugacugggcaugcugccaaaaugccaaaaugagucuuucaccucugguccuuugcuuuacuuccagaaaacugcaguagaaaccugaccugauguccaguuuucugugacaguuuuuauguaauuaagcgcaaauggccaaguagaauucauacaaagccuacuagaguaauauucauuggaggaaaacuuauaaagccuggaguaauaccagaugcacuuguccccacauugcccauucuuucuaugucaguguauagaagucuaaugacauuuucauacuaugagauagggcuuacaaccuugggcuuuauaguuuuuaaacugcauuaaguacagaagcugaagcuacucacuguugugaucaggugggauacaagagcagcauaauguggcauaguuuugguguaagcccaauuuugacaaccuagcauaaauuuugaggggaaguaucccuucccugguauaaucagaggcugugacccagaucuuacagguauaugacauggcaugccaguagcaggaaucuuugucagcauucacgguuagggaaguauuuaauaucagccuucccuuggcaugaugaaaagucuggcguguuugcuauauuuuuuaaaaaagauaccccuuaucaaaucauaaaaguucuuuuuauuccuaguuuauugauuuuuuaugaugaauagauuuguuuuuaauuuuaccaugcuuuuccugccauuagggaaagaaucauuugauuuuucuuuguuauuauuauaauauuguuuaauuuuaaucuguucauauuauuuucuaguuuuguacuaccuugagaaauuuggacucuuuuuuuuuuuuuuuugaucauucuuggguguuucucgcagagggggauuuggcagggucauaggacaauaguggagggaaggucagcagauaaacaaguaaacaaaggucucugguuuuccuaggcagaggacccuguggccuuccacaguguuugugucccuggguacuugagauuagggaguggcgaugacucuuaacgagcaugcugccuucaagcaucuguuuaacaaagcacaucuugcaccacccuuaauccauucaacccugaguggacacagcacauguuucagagagcacaggguuggggguaaggucacagaucaacaggaucccaaggcagaagaauuuuuuguuaguacagaacaaaaugaaaagucucccaugucuaccucuuucuacacagacacggcaaccauccgauuucucaaucuuuuccccgccuuuccccccuuucuauuccacaaaaccgccauugucaucauggccuguucucaaugagcuguugaguacaccucccagacggggugguggccgggcagaggggcuccucacuucccaguagggguggccgggcagaggcgccccucaccucccggauggggcggcuggccgggcggggggcugaccccuccacuucccucccggacgggguggcuggccgggcggggggcugacccccccaccuccuucccggacugggcggcuggcugggcagaggggcuccucacuucccaguaggggcggccgggcagaggcgccccucaccaaccggacggggcggcuggccgggugcggggcugacccccccaccuccuucccggacggggcggcuggccgggcagaggggcuccucacuucccaguaggggcggccgggcagaggcaccccucaccucccggauggggcggcuggccgggcggggggggcugacccccccaccucccucccggacgggcggcugacccccccaccucccucccggacggggcggcuggccgggcggggggcugacccccccaccucccucccggacagggcggcuguccgggcagaggggcuccucacuucccaguaggggcggccgggcagaggcaccccucaccucccggacgggguggcuggccggguggggggcugacccccccaccuccuucccggacagggcggcuggccgggcagagggguuccucacuucccaguaugggcgaccgggcagaggcgccccucaccucccggacggggcggcuggccgggcggggggcugacccccccaccucccucccggacggggcggcuggccaggcagaggggcuccucucuucccaguagaggcggccgggcagaggcgccccucaccucccggacgggguggcuggccaggcggggugcugacccccccaccuccuucccggacggggcagcuggccgggcggggggcugaccuccccaccucccucccggacggggcggcuggccggguggggggcugacccccccaccucccuccuggacggggcggcuggccgggcagaggggcuccucucuucccaguagaggcgggcgggcagaggcgccaccuaccucccggacgggguggcuggccggguggggugcugacccccccaccuccuucccagacagggcggcuggccgggcagaggggcuccucacuucccaguaggggcggccgggcagaggcgccccucaccucccggacggggcggcuggccgggcggggggcugacgcccccaccucccucccggacggagcggcuggccaggcagagggguccucacuucccaguaggggcggccgggcagaggcgccccucaccucccggauggggcggcuggccgggcggggggcugaccccccccaccucccuuccggacggggcagcuggccgggcggggggcugacccccccaccucccuucuggacggggcggcuggccgggcggggggcugacccccaccucccuccuggaggggguggcugccgggcagagacgcuccucacuucccagacgggguggcugccgggcggaggggcuccucacuucucagacgguguggcugccgggcagaggggcuucucacuucucagacggggcgguugccaggcagagggucuccucacuucucagacggggcggcugggcagagacgcuccucacaucccagacgggggggcagggcagaggugcuccccacaucucagaugaugggcggccgggcagagacgcuccucacuuuccagacugggcagccaggcagagaggcuccucacaucccagacgaugggcggccaggcagagacgcuccucacuucccagacggggugguggccgggcagaggcugcaaucucagcacuuuggggggccaaggcaggcagcugggagguggagguuguagcgagccgagaucacgccacugcacuccagccugggcaccauugagcacugagugaacacaacuccgucugccaucccggcaccucgggaggccgaggcuggcggaucacucgcgguuaggagcuggagaccagcccggccaacacagcgaaaccccgucuccaccaaaaaaauacgaaaaccagucaggcguggcggcgcgcaccugcagucgcaggcacucggcaggcugaggcaggagaaucaggcagggagguugcagugagcggagauggcagcagcacaguccagcuucggcucggcaugagagggagaccguggaaagagagggagagggagaccguggggagagggagagggagaccguggggagagggagagagagaccguggggagagggagagggagagggagagcucuccugaacauuuaaagaaguagagaaauuuggacucuuacauucauaaaaauagguuauagaugggguaaaggcuuaaauaaacagaaccucaaauuuucaucuaguuaaaacuaaacauaagaaaaauacaaucuuuugauaggaaaaauaaaauauugauaguuuuuacaacaaaaauuuaacgucuuuuacgauuaaaaaauacauaaaguuagacaaaaauagacugggagaaaaauauuugcuacacauauauuugcuacucauggaggacuaguauccaaauauauaaagaacucuuacaaaucaggagaaaagauauccugauggagaaauuugggauuaacgcgcagcuccagaugaggaaaugcaccugccaauaaacaaaaauaagcaucaccucacuauugauuagagaaaugcagacuaaaacaaggugacauuauuuuuucaucuaucagguugaacaaauuuaaaauguuuuguaguaucuaguguuggcuagaacauggguauucucauaccacauugcugagaauauaaauugguagaaauacuuuguaagguaauuugguagugucuauuaaaaaguaaacauggccaggugcgguggcacacaccuguaguuccagcuacuggggaggcugaaguggaaggauugcaugaggccaggaguucaagacuagccccgccaacauagcaagacccugucucuaaauuuuuuuuuuuaaguuagccaggugugguggugagcaccuauaguaccagcuacuugggaggcuaaggugggaggaucacagaaggccuucaagguugcauugagcugugaucacaccuguaaauugcuacugcacuguagccuaggugacacagugagacccgacucuuaaaaaaaaaaaaaguaaaccuguacaguguuuggaauccagcaguuucucccuugcauaucugcugcagagaaacacuuguacacuuucacaaggaaacauauacaaauauuucaauuccaguauuacuuguaauaucaaaauauugagagaugucuuuaacauccuuugaauuaacgauuggacaaaauguuuaguuguauuaugggauguuauaaaauguuuaaucaggaauuaauuauuguuucaugaaaaaaaaaacugugugaaguaaauauacagccaaugccauuucuguaaaagaaaaaacuacacacugaauauaguuucuccuuguguguauauguguguggcgggggguaaauauuuuuuuauauugggaaagauaaauaacaaauucucauuauagucauuaucuuuagggagcugggagaagaggacugcauuggggaagauugucaaagaggacugucuccauguucuaagcuuuuuuuuuauuauuauacuuuaaguuuuaggguacaugugcacaacgugcagguuuguuacauauguauacaugugccauguuggugugcugcacccauuaacuugucauuuagcauuagauauaucuccuaaugcuaucccuucccccucccccugccccacaacaguccucagugugugaugauccccuuccuguguccauguguucucauuguucaauucccaccuaugagcaagaacaugcgguguuugguuuuuuguccuugugauauuuugcugagaaugaugauuuccaauuucauccaugucccuacaaagaacaugaacucaucauuuuuuauggcugcauaguauuccaugguguauaugggccacauuuucuuaauccggucuaucauuguuggacauuuggguugguuccaagucuuugcuauugugaauaaugcugcaauaaacauacgugugcaugugucuuuauagcagcaugauuuguaguccuuuggauauauacccaguaaugggauggcugggucaaaugguauuucuaauucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggcgugagaugguaucucauugugguuuugauuugcauuucucugauggccagugauggugagcauuuuuucauguguuuuuugguugcauaaaugucuucuuuugagaagugucuguucauauacuucgcccacuuuuugaugggguuguuuguuuuuuuuucuuguaaauuuguuugaguucauuguagauucuggauauuagcccuuugucagaugaguagguugcaaaaauuuucucccauucuguagguugccuauucacucugauggugguuucuuuugcugugcugaagcucuuuaguuuaauuagaucccauuugucaauuuuggcuuuuguugccauugcuuuugguguuuuagacaugaaguccuugcccaugccuauguccugaaugguauugccuagguuuucuucuaggguuuuuaugguuuuaggucuaacauguaagucuuuaaucccucuugaauuaauuuuuguauaaggugcaaggaagggauccaguuucagcuuucuacauauggcuagccaguuuucccagcaccguuuauuaaauagggaauccauguucuaaguuuuaaaagaggaauuuaaauuuaaaaauuuaaaggugaauauuguacaauuaaaauuuuuauucaaaagcaaguauuauauuuucauuugcauuuaacauuaacagaaugauuuuuguaguaacaauauccaacuggauauuggaaagcauuuuaggacuauagagaauagagccuucuguuaguuucuugaauaguauuuuucuuuucuuuucuuuucuuuuuuuugagauggagucucacucuaucgcccaggcuggagugcaguggugccaucucggcucacugcagcguccaccuucuguguuccagcgauucuccuuccuuagccucccggguagcugggauuacaggcaugcgccaccaugccuggcuaauuuuuguauuuucaguagagacgggguuucaucaugcuggccaggcuguucucaaacuccugaccucaggcgaucugccugccuccgccuccuaaagugcuaggauuacaagcgugagccaccacgcccagcugaaugguauuuuuuaauauaauagaauuuaugauggguuaauauuaaaggauaggaauuauauguaauuuauaaacugcuuuuaaaaugcaagaguuuuuuauuacuguugaguguuggcuaauagcuaugguucuaaucaaucauaguuuguugauuggaauugaaagaaguuacuuuuggugccacuuauagauaggaaggaaaagauucacauuuaggaugcuguaaauacuuauuuuuuagaaaauuuuuccauaaguuggcugggcacgguggcucacgccuguaaucccagcacuuugggaggccgaggugggcagaugacgacgucaggagaucaagaccauccuggcuaacaugguaaaacgcugucucuacuaaaaauccaaaaaauuagcccggcgugguggcgggugccuguagucccagcuacucgggaggcugaggcaggagaguggcaugaacccggaaggcagagcuugcagugagccgagauagcgccacugcauuccugccugggcaacacagcgagacucugucucaaaaaaaaauuuuuuuuuccauaaguuauugggguacaggugguauuugguuacacaaguaaguucuuuaguggugauuugugagauguuggugcacccaucaccugagcaguauacacuccaccauauuugaagccuuuaacccuugccugcuucccacucuccccccaagucccaaaaguccauuguaugauucguaugccuuugaguccucauagcuuagcuccuaauuuaagugagaacauacaauguuugguuuucaauuccugaguuacuucacuuagaauaauagucuccaaucucauccagguuguugugagugccauuaauucauuccuuuuuuauggcugaguaguauuccaucauauaaauauaccacaguuuccuuauccacuuguugauugaugggcauuuggguugguuccaugauuuugcaguugcaaauuguacugcuauaaacaugugugugaaguaucuuuuuuauauaaugacuucuuuuccucgaguagauacugcguagugggauugcuggaucaaaugguaguucuacuuuuaguucuuuaaggaaucuccacacuguuuuucuauagugguuguacuaguuuacauucccaccagcaguguagaaguauucccuguucaccgcauccaugccaacauguacuguuuuuugauuuuuuugauuguggccauucuugcaggaguaaggugguaucacauugugguuuugauuugcauuucccugaucauuagugauguugagcauuuuuuuauauguuuguugcucauuuguauaucuucuuuugagaauugucuauucaguuccuuagcccacuuuuugauggaauuguuuuuuucuuacugauuuguuagaguuuguuguagauucuggauauuaguccuuugucagauguauagauuaugaagauuuucucccacucugcgggguugucucuuuacucugcugacuguuccuuuugccgugcaaaagcucuuuaguuuaauaaagucccaacuauuuaaucucuguuuuuauugcauuugcuuuuggguucuugaucauuaaaugcuugccuaagccaauguguagaaggguuuuuccaauguuaucuucuaggauuuuuauaguuucaggucuuagauuuuaguccuuaauccuucuugaguugauuuuuguauaagguaagcgaugaggauccaguuucauucugcuacauguggcuagccaguuaucccagcaacauuaguugaaaaggguguccuuucucaacuuuauaguuuugcuugcuuugucaaagaucaguuggcuguaaguauuuggguauauuucuggguucucuauucuguuacauuggccuaugugccuguuuuuauaccaguaccuugcuguuuuggugacucuggccuuauaguauaauuugaaaucagguaaugugaugccuccagauuuguucuuuuagcuuagucuugcuuuggcuaugggcucuuuuuugguuccauaugaauuuuagaauuuuuuuuucuaauucugugaagaaugauggugguauuuugaugguuuugauggggauugcauugaauuuguagauugcuuuuggcaguauggucauuuucacaguauugauucuacccauccaugagcaugggauguguuuccauuuguuugugucauguaugauuucuuucagcaguguuuuguaguuuuccuuguagaggccuuucaccuccuugguuagauauauuccuaaguauuuuauuuuuuuugcagcuauuguaaaagggguugaguucuugauuugauucuccgcuuaguugcuauugguguauagaagagcuacugauuugugaacauuaaucuuguauucagaaacuuugcugaauucuuguaucaguucuaagagauuucuggaggagucuuuaggguuuucaagguaaaugauccuaucgucagcaaacagugacaguuugacuuccucuuuaucgauuuggaugcccuuuauuucuugggcauccuugucugauugcucuggcuacaacuucuauguugaagaggcguggugagagugggcaucguuaucuuguuucaguucucagagggaaugcuuucaacuuuuccccauucaauauuauguuggcuguggguuugucauagauggcuuuuguuacauugagguaugucccuuguauaccaauuuugcugagaguuuuaaucauaaagggaugcuggauuuugucaaaugcuuuuucugcaucuauugcgaugaucaugugauuuuuguuuuuaauuuuguuuaugugauguaucacauuuauugacuuguguauguuaaaccaucccugcaucccugguaugaaacccacuuggucaugguggauuauccuugauauauuguuggauucaguuagcuaguauuuuguuaaggauuuuagcaucuguguucaucaaggauaucagucuguaguuuucuuuuuuuguuauguccuuucaugguuuugguauuagggcaauacuggcuucauagaaugaguucgggaggguugcuucuuucucugucuuguggaauaguuucaaaaggauugguaccaauucuucuuugaaugucugguagaauucugugaauucugugaaaagucugguccuggacuuuuuuuuuuuuuuuuuuuuuuuuuuuugagauggagucucgcucuguugccagucuggagugcaguggcgcgaucuuggcucacugcaaccuccgccucccagggauucaagcgauuccccugccucagccucccaaguagcugggacuacaggcaugcgccaccaugccuggcuaauuuuuuguauuuuaguagaaacaaggcuucaccauguuggccagguuggucucaaucuccugaacucaugauccacccgccucagccucccaaagugcugggauuacaggcgugagccacugcaccaggccugggcuuuuuuuuuuuuuuuuuuuuuuuuuuauacuuuauguuuuaggguacaugugcacauugugcagguuaguuacauauguauacaugugccaugcuggugcacugcacccacuaacucgucaucuagcauuagguauaucucccaaugcuaucccuccccacuccccccaccccccacaguccccagagugugauauucuccuuccuguguccaugugaucucauuguucaauucccaccuaugagugagaaucugcgguguuugguuuuuuguucuugcgauaguuuacugagaaugaugauuuccaauuucauccaugucccuacaaagaacaugaacucaucauuuuuuauggcugcauaguauuccaugguguauaugggccacauuuucuuaauccggucuaucauuguuggacauuuggguugguuccaagucuuugcuauugugaauaaugcugcaauaaacauacgugugcaugugucuuuauagcagcaugauuuguaguccuuuggauauauacccaguaaugggauggcugggucaaaugguauuucuaauucuagaucccugaggaaucgccacacugacuuccacaaugguugaacuaguuuacagucccaccaacguguaaaaguguuccuauuucuccacauccucuccagcaccuguuguuuccugacuuuuuaaugauugccauucuaacuguugugagaugguaucucauugugguuuugauuugcauuucucugauggccagugauggugagcauuuuuucauguguuuuuuggcugcauaaaugucuucuuuugagaaguaucuguucauguccuucgcccacuuuuugaugggguuguuuguuuuuuucuuguaaauuuguuugaguucauuguagauucuggauauuagcccuuugucagaugaguagguugcaaaaauuuucucccauuuuguagguugccuguucacucugaugguaguuucuuuugcugugcugaagcucuuuaguuuaauuagaucccauuugucaauuuugucuuuuguugccauugcuuuugguguuuuggacaugaaauccuugcccaugccuauguccugaaugguaaugccuagguuuucuucuaggguuuuuaugguuuuaggucuaacguuuaagucuuuaauccaucuugaauugauuuuuguauaagguguaaggaagggauccaguuucagcuuucuacauauggcuagccaguuuucccagcaccauuuauuaaauagggaauccuuuccccauuucuuguuuuucucagguuugucaaagaucagauaguuguagauaugcggcguuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugccuuggugaugugggcccuuuuugguuccauaugaacuuuauaguaguuuuuuccaauucugugaagaaagucauugguagcuuuauggggauggcauugaaucuguaaauuaccuugggcaguauggccauuuucaugauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaguugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuuccuucuccugcccaauugcccuggccagaacuuccaacacuauguugaauaggaguggugagagagggcaucccugucuugugccaguuuucaaagagaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucguuuugccaguauuuuauugaggauuuuugcaucaauguucaucaaggauauuggucuaaaauucucuuuuuugguugugucucugcccggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaaacuauugauuauugccacaauuucagcuccuguuauuggucuauucagagaugcaacuucuuccugguuuagucuugggagaguguaugugucgaggaauuuauccauuucuucuagauuuucuaguuuauuugcguagagguguuuguaguauucucugaugguaguuuguauuucugugggauugguggugauauccccuuuaucauuuuuuauugugucuauuugauucuucucucuuuuuuucuuuauuagucuugcuagcggucuaucaauuuuguugauccuuucaaaaaaccagcuccuggauucauuaauuuuuucaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguauccaguagucauucaggagcagguuguucaguuucuauguaguugagugguuuugagugaguuucuuaauccugaguucuaguuugauugcacuguggucugagagauaguuuguuauaaucucuguucuuuuacauuugcugaggagugcuuuacuuccaaguauguggucaauuuuggaauaggugugguguggugcugaaaaaaauguauauucuguugauuugggguggagaguucuguagaugucuauuagguccacuuggugcagagcugaguucaauuccuggguauccuuguugacuuucugucucguugaucugucuaauguugacagugggguguuaaagucucccauuauuaauguaugggagucuaagucucuuuuuagguuacucaggacuugcuuuaugaaucugggugcuccuguauugggugcauauauauuuaggauaguuagcucuucuuguugaauugaucccuuuaccauuauguaauggccuugucucuuuugaucuuuguugguuuaaagucuguuuuaucagagacuaggauugcaaccccugccuuuuuuuguuuuccauuugcuugguagaucuuccuccauccuuuuauuuugagccugugugugucucugcacaugagauggguuuccugaauacagcacacugaugggucgugacucuuuauccaauuugccggucugugucuuuuaauuggagcauuuaguccauuuacauuuaaaguuaauauuguuaugugugaauuugauccugucauuaugauguuagcuggugauuuugcuuguuaguugaugcaguuucuuccuagucucgauggucuuuacauuuuggcaugauuuugcaguggcugguaccgguuguuccuuuccauguuuagcgcuuccuucaggagcucuuuuagggcaggccugguggugacaaaaucucucagcauuugcuugucuguaaaguauuuuauuucuucuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuucccuuugaggguaacccgaccuuucucucuggcugcccuuaacauuuuuuccuucauuucaacuuuggugaaucugacaauuaugugucuuggaguugcucuucucgaggaguaucuuuguggcguucucuguauuuccugaaucugaacguuggccugccuugcuagauuggggaaguucugcuggauaauauccugcagaguguuuuccaacuugguuccauucuccccaucacuuucagguacaccaaucagauguagauuuggucuuuucacauagucccauauuucuuggaggcuuugcucauuucuuuuuauucuuuuuucucuaaacuucccuucucgcuucauuucauucauuuaaucuuccauugcugauacccuuucuuccaguugaucgcauuggcuccugaggcuucugcauucuucauauaguucucgggccuugguuuucagcuccaucaccuccuuuaagcacuucucuguauugguuauucuaguuauacauucuucuaaauuuuuuucaaagcuuucaacuucuuugccuuugguuugaauguccucccguagcucagaguaauuugaucgucugaagccuucuucucucagcucgucaaagucauucuccauccagcuuuguuccguugcuggugaggaacugcauuccuuuggaggaggagaggcgcucugcguuuuagaguuuccaguuuuucuguucuguuuuuuccccaucuuugugguuuuaucuacuuuuggucuuugaugauggugauguacagauggguuuuugguguggauguccuuucuguuuguuaguuuuccuucuaacagacaggacccucagcugcaggucuguuggaauacccugcugugugaggugucagugugccccugcuggggggugccucccaguuaggcugcucgggggucaggggucagggacccacuugaggaggcagucugcccguucucagaucuccagcugcgugcugggagaaccacugcucucuucaaagcugucagacagggacauuuaagucugcagagguuacugcugucuuuugguucgucugugcucugcccccagagguggagccuacagaggcaggcaggccuccuugagcuguggugggcuccacccaguuggagcuucccugcugcuuuguuuaccuaagcaagccugggcaauggcgggcgccccucccccagccucgcugccgccuugcaguuugaucucagacugcugugcuagcaaucagcgagauuccgugggcguaggacccuccgagccaggugcgggauguaaucucguggugggcuguuuuuuuuuuuuguuuuuuuuuuuuuuuuuuuugagacggagucucgcucugucgcccaggccagacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgccuggccugggcuguuuuuuaagccggucggaaaagcucaauauucgggugggagugacccgauuuuccaggugcguccaucaccccuuucuuugacucggaaagggaacucccugacccuugagcuucccaagugaggcaaugccucgcccugguucggcuugcgcacggugcgugcacccacugaccugcgcccacugucuggcacucccuagugagaugaacccaguaccucagauggaaaugcagaaaucaccggucuucugcgucgcucacacugggagcuguagacgggagcuguuccuauucggccaucuuggcuccuccuucucaaucauucuggacuuuuuuuuguugguaauuuuuaaauuaccauuucaaucucgcugcuuguuauuggucuguucaggggaucuaauucuuccugauuuaagcuaggagaguuguauuuuuccagcaguuuauucauuucuuccagguuuucuaguuuauguguguaaagauguucauuguagguuugaaugaucauuuguauuucaguggugucaguuguaauaucuucuguuucguuucuuaaugaaguuauuuggauuuucucucuucuugguugaucuugcuaauggucuaucaauuuuauuuaucuuuuugaagaaccagcuuuuuguuuuauuuaccuuugguauuuuuuuguuuguuuguuuguuucaauuucauuuaguuuugcucugaucuuaguuauuuccuuucuucugcuagguuuagguuuggguuugguuuguucuuguuuuucuaguuccuugagguguauccuuauaaugucaguuugugcucuuucagucuuuuugauguaggcacuugaacuuuuugagcuuuugaacuuuugagcuuuugauggagggcuaugaacuuuccucuuagcacugccuuugcuguauuccagagguucugauagguugugucauuauuguucaguucgaagaauucuuugauuuccaucuugauuucauguugacccaaugcuuacucaggagcagguuauuuaauuuccauguauuugcacgguuuugaagguuccuuuuggaguugauuuccaguuuuauuuaacuguggucucagagaguucuugauauaauuucaauuuucuuaaauuuauugaggcucguuuuauggccuaucauauggccugucuuggagaaaguuccauacacuguugaauagaauguguauucagugguuguuggauaagauguucuauauauuuguuaaguccauuuguucgaagguauaguuuaaauccauuauuucuuuguugacuuucugucuugaugaccugucuagugcugucaguggaguauugaagucccccacuauuauuguguugccaucuaucucauuucuuaggucuaguaauacuuguuuuauaaauuugggagcucaaguuuuggguggauauauguuuaggauugugauauuuuccuguuggacaagggcuuuuaccauuaucuaauguaccccuuugucucuuuuaacugcuguugcuuuaaaguuuguuuugucugauauaagaauagcuaccccuccuugcuuuugguguccauuugcaugagguauuucauaaaggcaccccuguacuuuaugagaguauguguuaggugagucuccugaaggcagcagaugguuggugaguuguuauccauuuugcaguucuguaucuuuuaaguggagcauuuaagcuauuuacacucaguguuaguauugagaugugagguacuguugcauucaucaugcuauuuguugccuguguacuuugguuuuuuuguuuuuuguuuuugccuuuuaacuuauauuuuuguuuuauagguccuuugugauuuaugcuuuuuaaagagguucuguuuugauguguuuccaggauuuguuucaggauauagggcuccuuuuaguaguccuuguggugguggcuugguaguggcaaauucucucagcauuuguuugucugaaaaagacuguaucuuuccuuuauauaugaugcuuaguuucgcuggauaccaaguucuuggcugguaauugucuuguuugaggagacugaagauaggacccaaucccuucuagcuuguaggguuucugcugagaaaucugcuguuaaucugauaaguuuuccuugauagguuaucuggugcgucugucucacaacucuuaagauucuuuccuuugucuuaacuuuagguaaccugaugacagugugccuaagugaugauccuuuugcaaugaauuucccagguguucuuugugcuucuuguauuuggaugucuaggucucuugcaaggccggggaaauuuuccuuaguuauucccccaaauacauuuuccaaacuuucagauuucucuucuuccucaggaacaucgauuauucuuagguuuggucguuuaacauaaucccagacuucuuggagucuuuguucauauuuucuuauuccuuuuucugucuuuauuggauuggguuaauuugaaggccuugucuuugagcucugaauuucuuucuucuacuuguucaauucuauugcugagacuuuccagagcauuuugcauuucugugaguguguccagugcuuccugaauuuuugauuguuuuuuuucuuuaagcaaucuauuuccuugaauauuucucccuucacuucuuguaucauuuuuuggauuuccuugcauugggcuuugccuuucucuggugccucucugauuagcuuaauaccuaaccuccugaauucuuuuacagguaaaucaaggauuucuucuuggcuuagauccauugcuggugaacuaguguaauuuuuuuugggggggagguguuaaagagccuuguuuugucauauuaccagaguugguuuucugguuccuucucauuuggguaggcucugucagagggaaggucuaggcggaagucuguuguucugauucuuuugucucaugggguguugcuuggauguaguacucucccccuuuuccuauggacguggcuuccuaugagccaaacugcagugauuguugucucucuucugggucuagccacccagcaagucuacccagcuccaagcugguaccagggauugucugcagaguccugugaugugaacuccugaucucaggugauccaccugccucagccauccaaagugcugggauuacaggcaugagccacugcaccuggccucaguucuuuaacuuuaugcucuuucacuuaauauaauauuuuugagguucacuguguuguagcaugcaucaguacuucauuccuuuuuaugacugaauacucuuccaugguacggcuagaccaaauuuuguuuacuuguucauuaauugaugggcacuugguuuuuucauuaguugaugggcacuuguuuuucuuucccauuuucaucuauuaugaauaauguggcucugaacauucauauauaaagcuuuguguguacauauauuuuuccauuuucuugcaaagauuucuauaaauagaauaacugggucauaugaugaguuuauguuuaacuuuuaaagaaauugccaaacuauuuuccaaaauaaccauaccauuucuauuauguaugagaauuucaguuuucuaugucuuuaucaacacacuuauacauuguuggugugaguguaaauuaguucaaccauugugguugaacuuaccuauguaacauguaccauuagcuaugaacaaaccuucacauguaccccugaaccuaaaauuaaaaguuuuuuaaaaaucacgcauggguguuagauuuugucaauugacuuuuguucaucuaugaagauaauuaugugguuuuuauucuuuauauuauuaauguguguuagauuuuugucaauggauuuuuauucaucugugaagaugauuaugugguuuuuguccuuuauauuauuaauguaauauauaaugugauuuucugguguuaaaccacuuuuacguuccugugauuaaugccacuuaauuauguauauaauucuuuuuacauauuacuggauucaguuugcugauauuuguuaagaauuuuuguuuuugguagaagggagauuguacuguaauuuucuugugaaauauuugucaugcuuuuuuaucugaauaguacuagcuucauagaauuaguugguuaguaaauguucuuuucucauuuauuuucugaaagaguugugaagaauugguauuauuauuauuuuaaauaucugauagaauuaacuggugagaccaucuggaucugugguuuuuuuuuuugaggugugauuuuuaauaacuaacucauuagaaauuauuuagauuuucuguuucuuuuugagucaucuuuaguaguuugguauuucuaggaauuuuuccauuucaucuaaguuaucuaauuuguugucauacaauuguucauaauaguuccucauaauuauuuucauuucuuuagugucaguagugauguguucccuuuuucaucccugguuuugguaauuugugucuuuccucuuuuuuucuugguuaguuuagaugaagguuugugaauuuuguugaucuuuucaaagaaccaacuuugggugucacugauuuuuuuuauuauuauuuuucuguguucuagucaauuaaccugugcucuaauauuuauuauuuccuuucuucugcuugcugcaggcuuacucuuccuaauuucuucauguggaagccuagguuauugauuugagacccuuuuuuguuuuugauacagguuucuaaaauaaauuuuucuccaagcauugcuuuaguugagcccuauacauuuugauuuguuguguuuucauuuucauucaacuucaaauauuuucucauuucccauuugauuucuucuugaucccugaguuacuuggaagugugguguuuaauuuugaaauauuuaaggauuucccugguuucuuuucuguuguugauuuauaauuuaauucaguucugguugaacaacauacuuuguaugauuucugucauuuuaaauguauugagauuuguuuugugacuugguauuuaauucguucuuggaaaugauuagcacugagaaagaauuuguauuuuuacaguuacuggguugaauguuuucuauaaucaguuagcuugaguugguugaucauguuguucaagucuucuguauccuugaugauuuucugcuuaguuguucuaucaguuauugggugggacuagacaucuccaacuauuauuuuuauuuuuauuuauuuuauuucaauaggcuuuuggggaacaggugguguuugguuacauggauaaguucuucagaggugauuucugagauuuugguguacccaucacccaaguaguguacacuauacccaauguguagucuuuuaucccuuacuccccucccucucuuccccccaaguccccaaaauccauuguaucauucucaugccuuugcguccucauagcuuagcucccaccuuuaagugagaacaugugauguuuggguuuccuuuccugaguuacuucacuuagaauaauggucuccaacugcacccugguugcugcaaaugcuauuauuucauuccuuuuaauggcugaguaguauuccaugguguauauaugugugugugugcgcguuuguguauauauauagagagagagagagagagagggcgcauuuucuuuauuuacuuauugauugaugggcauuugggcugguuccauauuucugcaauugugaauugugcugcuauaaacaugagugugcaagugccuuuuucauauaaugacuucuuuuccucuggguagauacccaguaguggguuugcuggauaaugguagaucuacuuuuuaguucuuuaaguaaucuccacacuguuuuccauagugguuguccuaguucacauucccaccaucaguguagaaguguucccuuuucaccauauccacaccaacaucuaucuuuuuauuuuuuaauuauggccauucuugcaggaguaaggugguaccacauugugguuuuaauuuugcauuucccugaucauuagugauguugagcauuuuuuucauauguuuguuggccauuuguauaucuucuuuugagaauugucuauucauguccuuaacccacuuuuugaugggauuauuuguuuuuuucuugcugauuuguuugagguccuuguaguuucuggauaucaguccuuuaucagaugcaccauuugcaaagcuuuucucccacucuguggguugucuguuuacuaugcugauuauuucuuucgcuguacagaagcuuuuuaguuuaauuaagucccaucuauuuaucuuugcuuuucucgcauuugcuuuuggguucuuggucaugaagucuuugccuaagcaaauguguagaaggguuuuuccaguguucuaggauuuuaaugguuucaggucuuagauuuaagucuuugauccaucuugaguugauuuuuauauaaggugagagaugaggauccaguuucauucuccuacgcauggcuagccaauuagcccagcaucauuuguugaauaggauguccuuuccccgcuuuauguuuugcuuucuuuguucaagaucaguuggcuauaaguaguuggguuuauuucuggguucucuauucuguuacauuggucucuuugccuauuuuuauaccagugccaugcuguuuuggugacuguggccuuauaguauaguuugaagucagguaaugugaugccuccagauuuguucuuuuugcuuagucuugcuuuggcuaugugggcucuuuuuuugguuccauaugaauuuuaagauuugugugugugugugguucugugaagaaugauggugguauuuugaugggaauuauguugaauuuguagauugcuuuuggcagugugaucauuucacaauauugauucuacucauccaugagcaugggagguguuuccauuuguuuguguaugauuucuuucagcaguguuuugcaguuuuccuuguagaaaucuuucaccuccuugguuagauauauuccuaaguauuuuauuuuauugcagcuauuguaaaagggguugaguucuugauuugauucucugcuggcucacuguugcuguauagcagugcuacugauuuguguacauugauuuuguaaccugaaacuacugaauucauuuaucagaucuaggagcuuuuuggaugaguuuuuaggguuuucuagguagacagucauaucaucagugaacagcaacaguuuaacuucnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagucaacuuuaauguuuucuccuauuccuuuucuccuuguuaccuaucuugcccuaaagauguacgcuaccuuaucuucagccucccuucuuuuagcugcuguccauauuucauucagauggacucugucuccuccugaauggcacuuccuagccaaauucucucuagugucugucucucaucuguagaaaaucuucacaugacagaguaacuucuaagaguaacuuuaauaccgcacuuacaugauauucauuuguuucuccccuuuggugauuugcccucccuuaauuauauagaguaaaauuucaucuaccaucuguaccuggaaacaaagaaguuucacccuugagauggguuuccaacaugaucuccagccacuccucuuccaauauuagucauccauucuacaaacuacucaaagaucuauccuggugucuuuaagugcugcccuauuagggcucaucuuaauccaucuccuucuaauccuucucauuaaacuucucacaaaagcuucgcauuacuuuucaagcacuuguucuucuuccauuguaucuacugcuuuucaaagucugcaauuaagagccaacauuugacugaauaaacccacauuuuuuaaggguuuacaagauuucccauucugggaaacacuuuccucauuuuaccuguccaugccacuccaccuacgcuuaccuacucuuuguauaguucucccuuuacacaguuuccagucucuccuuauuuaaucuuacacuuauggggccguaucccuccagucaauaccugccaaucuucaaaugacuccgucucuucugcaggcucuuccacuauuuuccccaguugacccuaguagaacaacuguuagucacuuguuuuuucagcuaucaucuuguguaucauucucaugaauuuagucuuuucuuccucgucaccuccacacuacucugaaaacacuugcacuuucaguucauuccagaccuucauaggguuccugccacugccuauggcaagaauccauuccauuuaaacuccuugaccuuucacucuauuggucacacuuguugcuucaaacaucauucaagcaaagauucccagauggcacuuccucaugacaccaguucuuauuuaucuacuuacucuuuguauucucuuuccuucuuugguuguaacccagcuuaacucacaucucucuacugcauaugcagcucugccaucuucugguguuccucauucuggcccucuuuaaugcccuucccuacccauacauauauauguauauguguauauauauauauacacacacacacacauauauauauauauauacacacacacacacacacauauauauauauauauauauauauauauauauauuuuuuuuuuuuuuuuuuuagacagaauuauuucacucuugucacccaggcuggagugcaguguggccugaucucggcucacugcauccuccaccucccgggcucaagugauucuacugccucagccucccaaguagcugggaucacaggcaccugccaccacgcccagcuacuuuuugcauuuuuaguagagaugggguuucaccauguuggcgaggcugguaucaaacuccugaccucaaaugauccaccugucucaguccccugaagugcugggauuacaggcaugagccaccgugcccagccccuacccacacuuuauauuccacacuccagccuaaauccuacaucuuuucaucuuuuagcuuccagccuccaucuucucuuucucuuccccugugauauuuucauucauguuucccuaggaaaugucugucacuuuuagccaauccucacauagcagaguaacuucuaggcaacuucaguggaacacugugcaauagucuacgauaucuuaacugucagucauccuuucacuugccaucucucucuuuuuucuuuuuuugagacggaaacucacucugucacccagguuagagugcaguggcgugauuuuggcucacugaaaccuccaggauuacaggcaugugccacuacgcccagcuaauuuuuguauuuuuacaaaaauuuuuaguagagacgggguuucaccaucuuggccaggcuggucucaaacuccugaccucaagugaucugccagccucagccucccaaaaugcuggaauuacaagugugagccacugcacccggccuuaccaucucuacagaaauagauauagacuuuuuuacuucacucuucauaaucacccauuccccaucuaguagcaauaauccauucucuggacaaacuacauguucacacucucuuaauaaaucaagccuaauauuucuaaaguugccaucuauagcuuuuuuguuguuuuuuguuuuuuuuuuuuagauggaguuuugcucuuguugcccaggcuggagugcaauggggcuuggcucauguuaaauugucagaguuguauauuaacaaggagaguuguguauuaacaaggagaguuaacaaggcucaccaacucggcuuaccacaaccucugccuccuggguucaagugauucuccuaccucagccucccaaguagcugggauuacaagcaugggccaccacgcccggcuaauuuuguauuuuuuuuuuuuuuuuuuuuuuuuuagaagacacaguguuucaccauguuggccaggcuagucuugaacucccaaccucaggugauccaccugccucagccucccaaagugcugggauuacaggcgugagccacugcacccggcccaucuauagcuuuuuaucagcauucaucaguuuauaacuuuccuaucaagcaaguccuuuaauuagccauucccucaaaagcuuuaagagcuagucugcugcugccuccuacugaauuccuugcuccuuaacccuuucuguguauuucccaugcagccgaccauuuagaccuagacaggauaccccauucuaaaucuuuauuccacaccugcucugccaguaggcccuuccuuauguaauauuuucuuuccuuugcuuccagucucuuauuucauacucucuuaugacuuuuggcccagcaaugcugucuuaccuuccuguugaugugugucauuccuuagugaccaacuccuuuucaucugaggacaacucuaauguugcuuuccaguaccauuccuccuucccuuucugaauuuguccuagagaaaaacucccucccaccauuuguacagcauucccacagacucaacacgauuuuccagguagguguguauugcuuauuuuggcacucacugcccagcuuuccucgauguccuacacacuaugcugcacccauugcuucucaguucaguccagaccugcauagacugcugcaguuagccuguacagauccaucucuuuugccuucuuucuaaucuuuugcccuagugacauacccuuuucuuuaauuauuauucuaacaaagcuuucuggaaauaccucauaagugucucuuacuuugucauggucucccccaggugguugagaccuggcagcucccucccaccuuucccacucugcccuuugccacacugcauuuucuguacccuggcccaacucacaugucccucuccugucuuagcugccagcaucuaucuuuucucuaauucgcuggguucuuuucauacaaaucuccuuagugguugacucucauuuucagugaauccucacaagacaagcuuaauuucagagaacaguuuuaaugcagaucuucagggcauucuuuccugauucucuuugguauuugccuugcuuugucuguguaacucucauauuuacauuauggcagugcauucaguauuuucuugccauggaaaggcccccgcaucuugccuccucgccccauuucgucauccucuccagcagcuucgacagauuacugccuagacuuccuuagaucccuguaaccucucauuguaucaaucaaaccauuuaaguaaaaaaauucccacuaagguuucaggaacauuaucucuacuaacaccauuccuauuuacuuccuuaaucucuuucucuguaucagguccuuauauguaagugucuucugucuuuaccuccacauaaaacucagccccugugcccagucugugaucugccuucauaccugauguugucucuuuguccuccucauuugcuguagccucucugcuuaauuggaaccacacuggguugcuauaauuaaugucucuccugacucuucauucuaacuugaucaugaccuuuuccccuaccauauucuguaucucuuucaugguuuaaaaaaaaugccucaccugaccuguucuggccuuguguuaacuuucacuucuuuccccuucucucugaagaaaauccuauccuaauuaaaccacagucguucuuuucucaaccccuaauggcauugaaauugauucugcaggcuugauagguucauucuuuccuauaugggaaaacccacugccaucgucuguuuucagcauauucuguugaauccaucugcucucugaauucagacccauucuucauaguccccaccaguggcuuaaauuaggcaccuuaucuagcuuaucucuaaccuuucaaucucuugacugccucagcucaccagagccuguuggaaaaucauuugaaauacaagguauuuuacaauuuauuccuaaacaaauuaucuucucagcaccuaggcauuagcaugccucuuacuguuuccagcugcccgguggacuuucuggccucuuuccuuuugccuguuuguacaucuuccucugcuugccaaagcucuuuugcaucuuuugagagccaguuaaacuauuauaucguuucacauuuuuuacaguuuucccaggcuauuuguuaaucccgcacccucacauggcacucucuuaaaacuuaaaggaucuauggcauugaguuguaaagucauagauagaucacacacacacacagcccacacacuuauuuaacuccuagacagcuccuagagacagagaucaugucucagucaucuuuuuauccaagugucuggcacauaagcuuauaccuuuacguguaaugucaacauguauugacagucacuacauguguggauggaugaauggauggaauuuaaagucaagacugagcagaugaaagucuuauuacccaaucugucguauauggucuucacaucugagccuguucuuuccucuccuugccuaucccccaaauaacuuuuuaacucucccaauaucuaauauuuuuuguaccuauaagcuuuuuccagaccauagacaagauccuaaaugccuuuucuucaucccugcuugcuaaauccccuccuucaaacauuucagaaaauacugucuuuacuuuuuauaaagacuucacuuuccaaaaauguacccccaccuccauuucuuauuacuuaacaccacuugugugaaaacauacaacugcccacuugcuuuuccauuuaagacacugacuuuaccaauacuagaaacucauuacugaccuacucacuuuaggcugaagguugacagauaaagcaaguucucucuggugaucuguggacccgccaucaguccacaaucuaaagauaguauugagaugcugaugagauuggucaauguuaaucugaugaucuguaugcuuuuuaccacagguuuuuuuuuuguuuuuuuuuuuggucagguccuacagcagugguucucaaaauauuuauuuuucaacauuuaggccccuuugauaggcauggcaaaaagcccccaaaaguaccucucugcugcuuucuucauaccaauagagaaacagucugcccauguuaucauuucuguacugcuguaacccacagcguggaauagacuuuacauucaugcuuugugagacugccuuccugacccgcuuguaggcugcuuuugagaaccacuaccccagacaacagggcauguguguuuaacuggaaaauguggaacacagugcugaguacagauggaaugauggaaacgucucccuugcacuccccacugaugcagguuugccucccuucuccuccaguugcaggcuccuuuagcugcaccaugaaguuuacaguccgggacugugacccuaacacuggaguuccagaugaggauggguaugaugaugaguauguggugagucuucccagcauagagacuuucuuugacaccuucacaacacuaagugacuucugccuugagagaacauuuuucuaggagcaucugacauaaacuuaagggauuucuauucuucugaaacagaugacaaauuaggaggaccuggacuaacccuccucuguaacuggacagcaccaggccagagagaauugagauuuaccacuucaucauuaaaacaaacucacccuuuuuuuucuuuauaauagggauaauuaagagaugaaaauaaugacaugauuuucauugagaucaguuuuauuuaaaaugauuuggggaggggguugguuuuguuuuuugguuuuuuguuuuugcuucagcagcuguuaguuuauagccagaucauggauuaaaaagccuucacagaauggagggaaaacuuuuuuuaaaaaauaucaaccucuuagugaaugaucagaggguaccgugugcccagaacucaguggucaagugugggugcaacaugacuacucuguaccucagggcuacagauguugaucugaggcucuugccagauguucuguuuucuugcuuuccuuugcuaagggcuacaacauuagauuuauccagacuacagaacuuaaacuauuuuggugguagaguuuucucuaggcuccggaggaccauauugacuaguuccuuuaucuuugcccuauaacagaaaggacuuuucuuuacugacugcuuauuacccacuagcuggaagaucucgaagugacugugucugaccauauucagaaaguacugaagccuaacuuugcugcugcuugggaagaggugggagauaccuuugagaaagaggaaaccuuugcccucaguucuaccaaaacccuugaaggugagacccauuuugcuaucaguauauugccugauaacaguauaacaccuaacaggcauauuuguuacuccagaagaacuccuuuaaaaaaaaaaaaacuucauaaaucucuuacuuaaaaggccagcacccugucuucaucaucuaauugaucagccauuuucuaguccaguaguagccucccucuacacaucaccaacaacccccuucaccaacaaacccuuccaccccagcucccagcauacacuggugcagagggagaucccugugcuuuacuuuccuaauacugucucauacaucuucucaacacagaggcugucaacaauaucaucacauuucugggcaugcagccaugugagagguccgauaaaguaccugagaacaagaauucccauucgcucuaucuggcagguaagaagcuuccaucagauuuuccuuccauuuucuugcaaagcuuaauaauaggauauagaugggcaucuuaugccuugcuguugucccaucaucccauuauaugaguaacaauuugauacccagucaaaaugaauaauuuguuuugcaugcuauucuugguuauucuuuuaagauguacauuuggcccaaaacaaaucucuccaacagauaccaaggccaccaccaacauuccuuuugaguacuccaaauugguauuuuugaauaccuucuauguaccugguuucaugggaauauaaaaauauauauauuuggaauuuauguuuguuuaggauucaguuuccacaagucucuggaaaagcuaaacuaaacuaauagaaaggagaugcagggauagcaugauaaauuucauuauccagugcuuguuuuggguucuuaauaugguuuuccuuacuuuuuucucucagguauauucagagguggcuaugauuuauuggugagguccaggcuggccuuagccgauggagugaccaugcaggugacugucagaaguaaagagagaacaccuguagauguuaucuuagcuucuguuggauaaaugcuuacuggacaagaggaaacugaugcacacuacauggucagugggcuuuuaggcuaguggcaucaguuucccagaaucagacuuuugaagaugaaugacuuuggagaagcaaauuaaacauuuggcccugagccagcagaucaagcaaaugucuaucuuugcgcauggguuguuuuuuuuuuuuuuucuuuuuauucuacuuggucagcuuugggacgauagugcagcuuugggugaucuugaaaaucaaauacuauccuauacuccagcugcuuaacuucauuuuauucuuuaauguguaccugaaagcuccuggcaaugcuggaaaauuuuuaucccagaggggugggggggaggggggaggggaagccagaguccacuuuugucacaauucauuuuuauuaauagaaaauaaacacuuauuccaguuucaa

SEQ ID NO: 191594 - RNA, 386544 nt, Homo sapiens
aaccugauccuccgguagcgaagggcuagaggcaaacaccgagcuccuccagagccgcccgggagcagggagggcuccgcuagcccggggggcccuccccgcggggcagaugguaaguggggcggugcagguggucgccuugggaagggagcgcgcagggggguaagguggggcggcgggaagugcuagaagucaccccagccaaacugaaggagcccaguuuccagcugagagggacccaggccguaauaaggauguccagccaaacgcagcaauaauuacuauuggagugacgccccgaaguugaccccaagcuacacagaggguggaguggugcauccugaacccaggacagagcuggaggcaaugauucaggguuugagaaguaucagcccaucggccuggcgcuuuaaggugcagcugaguaggaaaagccaacccacaucauauucccagagccuugcugcgcuuucuggguugucuuguucaaaacuagugaaagggaugggaaaccugcccaaccucacuuuagccacgaaaauaaugcucuuggccaguggccuuggacaaacagccucuggugcaacaaaacaaucaauaggaagaagaacuucauuccccucaccauccuccuuccccaaguuccuuugaccagcauaccucauucggcuuaaaggagaaagaaaacuaugugugacauucccucccagccuaccugcagccagccuccucaccacacaaacugcccaucccgcuucucuccucaucuucagagccaugauuccaagagacauugcaauacuacucacuuuaggugagaagacugccugaaacucugaacaauuucaccucccuugcccuuugccacaggggauucagaaaccuacaacugagagcagggaaauauacggacaggcuuggcacguaggaacauuacuuccuucacuggaguguaguucuccagacaacuuuuuaauuaugauuauucccuuccauugcacuccuggaaauuucaaagcacuuucuaaaacaucauuuuuuuuaugucagucauacauuuagagguaagggguugaugggauuaacugaaaggcuaaugacugucucaaaagcacaugcuguugcuagggaacccaagcuccugcugcucucuaaucaccagcguguuccguggaaaucaaacugcucaggguguuauuaaaaugaauggcaucggguuaaaggcauucuugcuuauguuguagcauccuggauuauuaucgauugccucacacccacauaucuuguuuuccuaauuugauuucuguauuugcgucacugccagggacacucagacuagaccagucaguucacuuccuguuucucagaacugguuuauauuuggucucguagcacuagcugguaaaacauuaucaaacugauccucuuggaaagaaaucuuugcuucccauugaaaacaaaauauuccaauuaaauuguaauuccuguggaaaacgucaucauuugaggaguagacugccaguugccauuugagaaacaauccuugaaauguaaagccuagaaaaaaaaaacaucaucuugauuucuuuuacccagaaucuucauuccucagcacuagaacuaagacaaacucgaguaaagaguagauuuaaguauacuucuaaaaugaaacgcauaaauaaauaaauaaauaaauaaauaaauacaugucgaagcuggggaaaucauuuagacuaaacaaggcauaaaauugaauggaauccaggcccaggaaggacaaguaauuuuggguuagcauuguggcauucggagaacacagugugacuacaaggcuacacuacaaauaggaaaccccaucacuuuguguacuaauugucuuuuuuaccaauuccucuaugucccuggacaagacaaccuuguuuuguuuuguuuguuuucaguuccuuccucuuuauaacaaggauauugcaaaggcaauaucagaaagauaagcccuauguaaauagguggauucugauguagauaauuuguuuagauggaaaaugaagcccuuugaaaaagauguauaauggcaucgauagccuggaugaccuugagugagccauuguaggucuuaugucaguuucuucguggaagcuuaaaugaaagugcuggacuaaaggauuucuaagguuccucccauuuacaaacuucugugaugagauugaacucacuacauaaaaauuucaauuuuagcuggauuuugcaauguuaaauuuaagcacugaaccuuuaauaucuauccauaggaaccuugagggaaaugaugggaaaugacuuucuauugauguauccauuuuuagugucuguugacagaaaaauaaaauuuaccuugcuccccauguacuuagucucucccugccucagugguauuauggaagcaacaggauaagaguuacaaaaggauauaaaaguauagagaaaguucuuucagucuacucacuuauuuauuaugacaacgugucacuguguuacccaggcuggccuccaacuccugggcucaagcaagccucccaccucagcuuccugaguagcuggggcuacaggugcacucaaccaugccuagccuuucagucauuuuagauauagguaauccuaaguacucugaugaucaaagugguggaaugauggaggaagggguguacaaaaaaauaaucaacugaauccucauggaacuaauaauaaucuauuugccuguguuuuaauuagugcuaggcaaaaauagaccuagcucagcucuuggaauuuuucaaauucacaguauugagaaguagcaugaagaaaugugagauuugugccagagagaaaagaccugacuuugaaacccaacucugccacuuuauucauuauugagugcuugcugugugucagguacugugcugggugcugggaauacaaagaugaauaagacacaguuucugcucugaaggacauuauaguaucaugagaacaaagaugaauauacaguugaucacgcaacagugagaugauaucaacaggggagcucauaagaauggugccuaacccugaccacgcauagggucucuaaccacacaaggugaaucuugagaugcguucugaaggauaaguagaaguaagccagacaagugggcagguuacagggaaagauauuccaagcaaagaaaguacuauguguaaagaccuuagggaaaaagcugugugcagggaguugagggugaagaacagagccuggcaaguagguucuaaauaaauacauuguauaaaugcauggcagaaguccuggaggagaaauccagaaagauuagcaugguugaguauguuauccuaaaaaguuugaacuuauucuaaggccaguggagaaccacugaugaauuuuaaggggcauagugaacugaucaaauguucauuuuagaaagaucucucagcugggugcaguggcacacuacuguaaucccagcaguuugggagguugaggugggcagauugcuugagcucaagaguuugagaccagccugggcaacauggugaaaccccugucucuacaaaaauacaaaaaaaaaaaaaaaaaaaauuagccaggccugguggcacacaccuguagucccagcuccucaggaggaucacuugaaccacagaagcggagguugcaaugagcagagaucaugccacugugcuccggccuggggaaaccuacaaucaugguggaaggcgaaggggaagcagccaccuucacaaggcagcaggagagagagagcuugcgggggaaacugacacuuuuaaaaccgucagaucucaugagaacucccucacuaucgugagaacagcauggagggaacugcccccaugauccagucaccucccaccaggucccucccucagcacguggggcuaacaguuugagaugggacacagagccaaaccauaucacauuauaagaaagaaauaaugaugcaugucuaaacuaagguagcaagaauggacauggagagaggaagcauugaaaggguuuaagauauauuaaggacauagaaccaacagaauuugauuauugaugguauccuccaucaaugcuauccuuccauuuucauaagccauaaaucugcucccauuauauccugcagauauauccugagguccaagauagggaccucaggaggaaaagcagguuguggagugaagguaauuaguuuaguuuucaacauguugaguugaaguguccauagaauaucaaagugaagcugucuacuacauaauugaacagggaagucuagaacucaggagagagaucuaugcuggagucaucagaauaaggaauaguucauggaaguagaugaaauccccaagagaaggcauagagaaaggaaagaagaggaucuacuuuggaacccuaugaaaacccugauauuuaaaaagugaggaaagaaaaaauacaggggaaaaauaucccaagagguaggaggaccaggaacaaguaguuucaaaggagccaggggaggaaacaucagcaguauuaaaugccagcuagaagucaagaaaaagaggauuguggccagcugcaguggcucacaccuguaaucccagcacuuuggaaggccgaggugagcgaaucaccugagguuaggaguucgagaccagccuggccaauauggcaaaaccccaucucuacuaaaauuagccggguguaguggcacacaccuguagucccagcuacucaggagcugagacacaagaaucucuugaacccaggaggcagagguugugaugagcugaaauugcacaacugcacuccagccugggcaacagagcaagacucugucucaagaaaaaaaaaaaaagcaaagcaaagaaaaagaggacugaaguuuuuggauuuaguaaggaggucauuguuguguucggcaagaaggaguuuauuaguaaaauggggauaguagccaaacugcagugaguucaagacaggauaagaguagaggaugcagauagaugaaguucuuuuauauaagaaggacuaaagggcaaguagggaaggaaaauaaaagagagugguguaauccauggucugcaagcuuaaggcugcacaaggaaagaaggaaauacuacacuaauagaauucuucauucucucaggcuucaaauuaaauggcauuaccacccaccaauugcucaacacaaaaagcauguagauauucuugauucuucucuuuuccuccguuuucacaauccucagaauucaggucaacuuuaccuccaaaacauuuccaaaaugucucuuucggucuccacugcuaccacccuaauacaaaccaucaucccucuucugugcucuuguaauagcuuucuaaaugguuuuccugcuucugcucuuguccucauucaccacagcacagcuagaguuucauaaaucauaagucuuaagacauaaaucagaucaugugauuucucaucuuagaaucccuccaugucugcugauggcaccugugauaaaguccagacuccuccuccaugcagggcccguggagcccuguacggcauccccgaccaccucuucaaccucaucucccaccacucuccaccaccgcagugacaccagccuuauuucucuuccucaaacuuguugaauuugcucuuguauuauaggauuuacccuauauacuuccuuuuccuggaauacucuuuuggucauucugaucuuugcuuauaugucaccuccucaaagaagcccucccugaccacgccaccugaaguguccuucucucuccacguuuccaaccauccuagauauauuuuuuucauaguaauggaacuuuauuucuauuuguuuuuaucacauacgguugaaaacuccucuaaaaugcaaaccuugugaagauuacuggcauauaucaggcacuuaaaaaauauuaauuagggccgggcacgguggcucacgccuguaaucccagcacuuugggaugccgaggcgggcagaucacgaggucaggagaucgagaccauccugacuaacauggugaaaccccaucuccacuaaaaagacaaaaaauuaguagggcaugguggugggacuauauaaugaauauauauauauauucauuggguguuuguaguaggaaaaggagaagagcaaccauuuauuagaaauuagagacaucaagaaucagucuuaguguaauuggaauggcuaguggugaugauuacuaggauuuuaagauuuuggaaguggaagaguuaccagcugugugauccuggacguuuauauucucugagccucacuuuguaguuaacaauacuauaugccucacaaggcuguuaggaaaaugaaacgaaauggaauagguauaggcauaaggcagucuugugaaauuauuuucaggaauucaagacuucugcaaaucaauucacacauucuacauaugcacucccuuguaauggaguuagcccuugaugauuacuuauuauuagaauaaaaaaauugacuaaaucauuacuuugaaaagauaguaggauaucugauagaacauggaaauuaaacuauuuaagaagaaaucagaguacucccacaaauccauaaaaaaaaaaccuuuaaaacucuggaaaauuggguaaaggguaugacaaacagauuguagucaaagaaauacaauggaucuuaaaauauguaauaauaaaaggcaugugcaucacaacugcagugacaucuauuuuuuacugucaaguugacaaaaauaaaaaaguuuaauaacauacuuggcuggccaggcugggaagcaggcacuuucuuauacugucagugggagugaaaguggguaucacgucuauggagggcaaucuggcaacauuuaucaaauuuuuaaauguacaaagccuuuacccuggcaauucuacuuuuauauauuuauccaauagauauacucacacagguauuggaggaugacuuuucuaggaccuuuucuaggacugaagcacgauuuauaguaguaguuaaagacugaaaacagccaucaauagagaagugguuaaauaaauuaugugaaagaggcugggcgcgguggcucaggccuguaaucccagcacuuugggaggcugaggugggcggaucacgaggucaggagaucgagaccauccuggccaacauggugaaaccucgucucuacuaaaauacaaaaaauuagcugggcgugguggugcacaccuguaaucccagcuacucgggaggcugaggcaggagauuugcuugaacccgggaggcagagauugcagugagccaagauugcgccacugcacuccagccugggcgacagaccgagacuccaucucaggaaaaacaacaacaacaacaacaacaacaaacaaacaaacaaagaaaaaauaaaaaacaggugaaagauaggcagcuguuaaaaguuugagacaauucuaggcauacuuaugugaaaagaucuucaugauacauuacuaaguaaaaaaaauuacaaugaagaacaacguguauuuugcuagcauugcauuucuuuuuaaaagacaguuuacauuuuuuggucugaaaaacauuauuuguggggagauaaaauagagcagagaaugagcagauguggagagaauaguuggaagguacauuaaugguuccugugagagaucaugguugcccagauuaaggcagugaaacacacagggagagaaaugaugagagccaagaguuauuuuaaagaaacugaugauugauuggaaauaguggguuauggagagggagacauugucauaguugacuucucucccaagaucagguacaugaauagaggugucaagaccaugacuaagauggagaauccuaggacagaaacagaauugcagggugauacaguuuggauauuugucccauuuaaaucucauguugaaguguaauccccaauguuggagguggggccuggugggagguauuggaucaugggggcagaucccucaugagccuauugaugaugaaugaguucucgcucaauuaggucauaagagaccugguuguuucaaagagucugggaccucugccuuuucucucuugcuccugcucacaccaugugacuugcuggcugcccuucccuucugccaugauugaaagcuccuguaauagucaauucucacacugcuauaaagacauaccugagggcugggugcaguggcucaugccuguaaucccaacacuuugggaggccgaggugggugaaucaccugaggucaggaguucgagaccagccuggcaaacauggugaaaccccaucucuacuaaaaauacaaaauuagcugggcacaguggugggcaccuguaaugccagcuacucaggaggcugaggcaagagaaucgcuugaaccugggaggcggagguugcagugagccaagauggcgucauugcacuccagccugagcaacaagagcaaaacucugucucaaaaaaaaaaaaagaaagaaagaaaagaaagaaagacauaccugagacuggcuaauaagaaaauagguuuaauuggcucaugguucugugggcuguacaggaagcaucgcuggggaggucuccggaaacuuacaaucauggcgaaaggugaagaggaagcaaacacaucuucacauggccagcacagaagaaagagaaugaagggggaagugcuacacacuuuuaaacaagcacauaucuugagaacucacugacuaucacgagaagaacaagggggacaucuuuccccaugauccaaucaccucccaccaggucccugcccuaacauugggaauuacaauucaacaugaguuuugggugaggacacagagccaaaccauagcauuccauccuggccccucccacauuucauguccuucucacauuucaaaacccaaucaugccuuccaaacagucccucaaagucuuaacucauuccagcauuaacuuaaaaguuuaaguccaauaucucaucugagacaaugcaaguuucuucugccuaugagccuguaaaaucaaaaacaaguuaguuacuuccaagauacgauggggguacaagcauuggguaaauacugccauuccaaaauggagaaauuggccaaaacaaaggggcuauaggccccaugcaaguccagaacuccagagggcagcauuaaaucuuaaagcucuaaaauaaucuccuuugacuccaugucucacauccaggccacaccgaugcaagcggugggcucccaaggccuugggcagcuccaccacuguggcucugcagcauacauccccugcagcugcuuucaugggcugguguugaauggcuguggcuuuuccagggcauagugcaagcuaucaguggaucuaucauucugggaucuggaggacaguggcccuuuucuuacagcuccauuagucagugcucuaguggggacuuugugugggggcuccaacuccacauuucccccccacacuacccuaguagagguucucaaugagggcucuauuuccacagcagacuucugccuggacauccagacauuuccgugcauccucugaaaucuaugcagagacucccaaaccuugauucuugccuucugugcacccacaggcccaacaccacauggaagccaccaaaacuuggggcuuacacccucugaagcaauggccugagcugcaccuuggccccuuuuagccauggcuggagcuggaguggcugggaugcuuucugccuugucuuggcuauucacauuuggcucuucuuuacuuaugcaaauuucugcagccuuaaauuccuccucagaaaauggggcuuucuuuucugcugcauggucaggcugcaaauuuuccaaacuuuuaugcucugcuuucuuuuuaaauauaaguucuaguuucaagucauuucuuuguuuaugcaaaugaggauaggcuuuuagaagcagccaggccacguguuggcaggcgccuguagucccagcuacucgggaggcugaggcaggagaauggugugaaccugggaggcggagcuugcaaugagcugagaucgugccacugcacuccagccugggggacagagugagacuccaucucaaaaaaaaaaaaaaaaaaagaagcagccaggccauaucuugaaugcuuugcagcuuagaaauuuuuucugucaggccaguugcaauggcucacaccuguaaucccagcacuuugggaggccgaggcggguggaucacgaggucagaagaucgagaccauccuggcuaacaacggugaaaccccaucucuacuaaaaauacaaaaaaacaaacaaacaaacaaaaaaaaacuagccagguguggcggugggcgccuguagucccagcuacucgggaggcugaggcaagagaauggcgugaacccaggaggcagagcuugcagugagcugagaucacgccacugcacuccggccugggagacagagcaagacucccucucaaaaaaaaaaaaaaaaagaaaaaagaaaagaaaauuuuucugccaaauacccuacaucaugucucugaaguucaaaguuucauagaucuugagagcaggggcauaaugccaccaaucucuuuccuaaagcauagcaagagugaccuucacuccaguucccaauaaauuccucaucuccaucugagaccaccucagccaggacuucacuguccauaucacuaucagcauuuuggucacaaccauucaacaagucucuaggaaguuccaaacuuucccucaucuuccugucuucuucuaagcccuccaaaguguuccaaccucugcccguuacccaguuccaaaguuguuuccacauuuuuguauaucuuuauagcaauaccccaauucugguaucaauuuucuguauuagucuguucucacacuguuauaaagacauaugugggacuggauaauuuauaaagaaaagagcuuuaaucggcacaugguucuguggagcuguacaggaagcauagcuggagagaucucaggaaacuuacaauaauggaggaaggcaaaggggaagcaaacgcaucuucacauggcuggcacagaaaagacagggugaagggggaagugcuacacacacuuucaaacaacagaucucgugagaacucacucacuaucacaugaacagcaagggggaaauccgccuccaugauccagucaccuccuaccaggucccucccccaacauugggaauuacaauucaacaugagauuuggguggggauacagagccaaaccaugucagcuuccccagacucucaucagaaacagaugcagcaccacguuuguacagccagcagaaccaagaaccaacuaaauuccuuuucuuuaaaaauuacccagccuccauccuggugaacacggugaaaccucgucucuacuaaaaacacaaaaaauuagcugggugugguggcgggugccugcagucccagcuacucgggaggcugaggcaggggaauagcaugaaccccugggggcggagcuugcagugagccgagaucgcgccacugcacuccagccugagugacagagcaagacuccgucucaaaaaaaaaaaaaaaaaaaaaaaaaaaaaauuacccagccucagauaugucuuuauagcaaugcaagaaaugcaagaauggacuaucacacaggggaagaucaaaaguucuaagugcagauguccccugcagaguuguagauaugggugugagguucauaagagcugcuggaacuggguuuauaaauuugaaagaagauugccuaggaggguagauagaaagacucaaagaaaaguggguccaggucuaauccuugaucauuuaagacugaaaagaagagaaagagcuggcacuggagacugagaaucagaaaccaggagacuacggggccaaggaaaccaagagaagaaucuguuaaggaggaucagcucuuuguuaaacacugccaaaaggucaagaaagauuauuuuaauuuguuucucucguaagcguuaagcuccuugagaguuaguauuauuuuauuauuuauuuuuguuucccuggggcuugcccugugacccacacauaauaaaugaucaguaaacuuuuguuagauugaagaaagagagaaagaugcauggcaagaaaggcagacaugcagaaagacaguagaauuuaugcuugggucucaaaaaauaaauaaguaaaacagauucccuugaaguugacugcaaacccagcuugaucuuaggaaauguaaggagguucuuucugcucccuguguuuuacucuugagcuaacacauugauggggcucccacagaaccauauuguugccauguaaguaccuucagaaaacauuuugagaagugauauucaccugugucuggucaaucugagucauuuuuaucuuuauuuagguccuaggugaugacgaaaagggcaauuugcuuuuccucgucuaugacuccaccacaucacccugaaugaguugauggaaacgggggcauccauuucugugccacuacaguucuguaauacacuguaaucacucauaacgcugcccagccccaguuucccaugagagagaaaggugacuacuggcaggaagagacgucuaaccucuuagagaaaccaccagcuucuuagucuguuauuguuucugcauuaaaguguugcugcgggccgggugcgguggcucaugccuguaaucccaguacuuugagaggccgaggcgggcggaucacgaggucgggagauggagaccauccuggcuaacacggugaaaccccaucucuacuaaaaauacaaaaaaaauuagccgggugugguggcccgcgccuguagucccagcuacucgggaggcugaggcaggagaacggcgugaacccgggaggcggagcuugcagugagccgagauagcgccacugcaguccggccugggcgaaacagcgagacuccgucucaaaaaaaaaaaaaaaaaaaaaaaaaaaguguugcugcuaucagggccgcuguacagaauaucaaagaaggacauguuugacucuguucuaagaacguggagcucuucuacauaauaaaagagaguguccuugaacuggaaauuuuaggaaauacaguaauagauguaguugaaacaauauuuaaaauguuaugccauccuguaucauuuaguuauaccaaagaucagcaaacuuuuuccauuucuauaaagggccagaaaggaaauaaucuaggccuuccuggcccuacagucugucucagcuacucaauucugccauuguagugcaaagcagccacagacaaaauuuaaaugaaugaaccuggccauauuccaauaaaaugaauuugaauuucaaauaauuuuuaugugucauaaaauaucauucuucuuuucacauuuuccaaucauuuaaaaaugugauggccugggaaauagcaagaccuugucucuacaaaguacaaauaaaaauagcugggugugguggccugugacgaggcagguggaucacaaggucagaaguucaagaccaaccuggccaacauggugaaacccugucucuaguaaaaauacaaaaauuagccaggcaugguggcaggcaccuguaaucccagcuacuugggaggcugaggcaggagaauugcuugaacccagaaggcagagguugcagugagccgagauugugccacugcacuccagccugggcaacagagcaagacucugucucaaaaaaaaaaaaaaaucuacuucuuacauaguacaguacuggguauuauggaguugaagauaaaaggauagauaauucauaaguagguagguagguagacugacagacaaaagaucuagugacugauaaguucugugagaauuguucagguguaucacaguaucaauguauaaaugcagucuuuuaaagcaacaauaggcagucagacaaaacuaaguuuaaaucugagcucuuuugcaucccagcugcaugaccuuggggugauuacauacaccauauaagcuucaguuuccucuuuuugaaaugaggauaauaacaccuaccucucaaggagguugugagaauuaaauaagaucauguauguaaaucagcagguguaguaccugggaaaugguagacaaugaguaaaugguagcuguuguuguaguauuacagcaauaugaagguagguaacuuauucaaaagaagcacacaaccaaaggcaaagcagaguaagcuuguaagucaagaggucacagacacauauagaaacccgcaaaccugggggcugaacaccuggccgagaacauuuggcugaaaauaaaagcagaagugacauugucacaggagcauacaauaaggcaccuggccaguugucuugcuuuugucuucucuagcaaccagcugcuggguugucuaaggagcccuacuuauggguccaacccccagccuccccaguacuuaaacgcuggcucagacuggagaaagucaccauuaguaucggccccaccauugugcuuccuuucaguuaggucagccauggggccucagacaucuguagcucccuccuauugugccuccccaccccucugcccaauauggguuuccaccuugcccucaacaccucagucucugguccuccugccuuguaucccagucucccuuuggaugugggucccuugucuugaaccccagccuacuuuaccaugauccugaugucuucuuuagcuuaguucugaccagucaucuuugcagagggcuguauucugcugccuacaccccugcugugcucuccucaaaccaugggacauaugcgccuuccccuuuauagauaacccauugcuaggguaaggcuaaacugccugguauuaacagcuuccugaacuuuaugugauuaagagacacaagguuuugcagaggccagcugcccagauccaagcugguuucuguauucauagcccgugcucuagggagcaucccccaacccuggucuuggcucauacccucucuccacuggcuguaugcagucaacuacuccuagcaugccuugugauccuguuauggcaacaucaguaaugcuuucccaauacaaaugacaaaauuauuggcacagggacacgauauagggguaauggagaacuucagcuuaucugauaucuacugacagucucauucugcugaaaagugaucgucaaauaaaguuggcaugacuuaaauuuaaacuaauugcuuacugaagaaguacuauucugugcuuaauucuaaccagcuaagaaaaauauguuggcaaaguagaagugacaaacaacuuaaaauaagugaccagggcagcuuugaauuuguaauagccaaagaaggcaauucugcaccugcuaaccugacaugaacgagaggagcaaguuaagagaaaauauggacacaagacucccucuggccaggaacuaggaaauaaagggcaagaggagucauaugauuggaaguguacauuuuuacaaaaucagugguuuaaaugaagaaaagacgagcauccaaaaaaagaucaggcuaggcacuguggcucacaccuguaaucccaacacuuugagaagcccaggcaggaagauuccuugaggucaggaguucgagaccagccugggcaacaaagugagacuucugucucugcaaaaaauuaaaaacagccuggcacgguggcucacgccuguaaucccagcccuuugggaggcugaggcaggagaaucacgaggucaggagaucgagaccauccuggcuaacacagugaaaccccgucucuguuaaaaauacaaaaaaaauuagccgggcguggugguggccaccuguagucccagcuacucgggaggcugaggcaggagaauggcgugaacccaggaggcagagcuugcagugagccgagaucacgccacugcacuccagccugggcgacagagcgagacuccgucucaaaaaaaaaaaaagauaaauauaaauaaauaaauaaauaaauaaauuaauuaauuaauaaauaaaaauccagaagaaaaagauuaaaaagaucaaucugguuguucuggaaguguucaauuaagcuuguacguuugaaggacauguacaaaaggcaggagaagggguauauaacgaggcuuccuucaaaaaggagggcucagauccgugagacccaugagaauaaugccagaagggcuaaugaccagagacagcugaggucugggaaaaguauugaagacaaugaauuaugaacuuuuauuuuugcuuauguuuauaguaaagaauaauaaagaaggaaggauaguaccauugaauggggcagacugucauaugugaguaguuaagugaaaaauagagucauuuaacuauagcauguccuagauucuaagguacagauauccccccauguuuuuaauauuucuaaaaugagaauguagguacauuuaacacggcgguguuuuuugggagggcucucaaaacagccauuaaaugguggugcauccuaccauauauauuuuuuuuuccugauggaguuucacucuugucacccaggcuggagugcaguggugcgaucuuggcucacugcaaccucugccucccggguucaagcaauucuccugccucagccucccaaguagcuggaguuacaggugcgugccacugugccuggcuaaauuuugcauuuuuaguagagaugggguuucacccuguuggccaggcuggucuugaacuccugaccucaggugauccuccugccuuggccucccaaagugcugggauuacaggcaugagccaucgcauccggcccauauguugaucuuagaauagaagaaauauggccgggugugguggcuuacgccuguaaucucagcacuuugggaggcugaggugggcaguucaccuaagguugguaguuugagaccagccugaccaacauggaaaaacuccgucucuacuaaaaauacaaaauuagccaugugugguggugcaugccuguaaucccagcuacucgggaggcugaggcaggagaauugcuugagccugggaggcggaggcugcggugagccgagaucaugccauugcacucuaaccugggugacaagagcaaaacuccaucucaaaaaaaaaaaaaaaaagaaagaaaagaauagaagaaaauggaauuguuuuucacuuaguucugcugguaucaaccacacucagcagaugaagggucuacuugggaucuuggaaguggcaguguagccagugaccacuaacaggugggaaagagucagaaaggaguuuggaggccacacgcagaggcauauuaucucauggagcacacagaggagagugggcgaguacgacugaagaacaggagugcagcaaauauuagagacaggacaagaaggaaaaacugaucaaaaccucugagaagggguagagagagcccauugccggcccacagaagccacgucacugaacaugugugucacagaagaggauggaauggagacaggggauauguguugaaaagaucaggcauggccaagaugcaagaaggaauaaaagaacugcugugaagauacucagaacagugucuaacaugcagucagaugggaauggcuugcccugggcaggacauuuugaacugugccuggagcauaguaugugucuaccacuguguccuaccucuucugaaucaauuaaaugauugacuuaaagcccuggugcuccagguuccaacuauguggcuucgauuaaccacauagaagucuccucugggaagguauuuagaucaggauguggguuugggaucacagaucaggaaaagacauugugaacugguauaagcaagaugcugaguauauuuguuuuuguuugcuuauuuaaaaaaugacaaggaaugguccgaauaaguaaccagggaaaaagggagccaaaagccagaaacauuaccagaauaaauucaggggagaguuggagcuguggucuguuucuacuaggucuguggaacucauguugaagaaggaauuuagaaaaccuauagaucaguuggcuguggaggaaauuguuccaaccauauaugagcaggccccuagacacugugauguguccaagugguccauaugcagcuugaacauaaagagaagggaccgaaguaucgccucugauucaaaaaaaaaaaaaaaacaacaaacaaaaaauggaaaaacauguggccaggaagaauggaaugcauuucagauggauuaaagaauuaaaugugaaaagugacccauauaauaggggugauaugugcugaaaagcugaaaguaguguaagcauuuuuugaccuuggagugguaaaggccuucaugagcaaaaaagcaaugguuuaugguuuauaaaagaaaagcauuguacuugagaggcugaagcaggagaaucacuugaguccaggaguuugaauccagccugggcaacauagcaagacuuugucucuaaaaaagaagaagaaagaaaggaaaacauugauauauuucauugcuuagaacuuuuagcuuauguagauaaggcaguagcacaaacaaaauuaaaagauacaugagaaauucuagauuuuuuuucauagggucuuguucuguugccuaggcuggaaugcaguugcacauucauagcucgcuguaaccuugaacuccugggcucaagcaauccuuccagguagcuaggacaacaggugugugccaccaugucuggauaauauuuuuuuuuagagauggggcgucccuauguugcccagccuggucucgaacuccuggacucaggugauccuuccccuucagccuccggaguagcuaggaccacacgugugugccaccucaccuauuuuuuuuuuuuuuuuuuuuuugguagagacaggaucuugcucuguugcccaagcuagagauucuaggacuuuauguauaugacaagcgguagugucuuuaacaugcaaacaacucauacacuuacaagaaaaagacaagaucucaaaagaagaacggguaaagaacaacaaaaggcaaaaaggaaaaaaaggaauucaacuggucaaugaaaaugaaaaugguccaguuucauuauuaauuaaugaaaaugcaaaucaaaguaaaacccagaugucuuugugccuagcaaauuguaagaacuuuaaaaugauaucuuacauggauaaagagucagggaaauaagcacucucauaccacauugggaauauaaauugguauaaaccuucugagagcaauuugguauuguguguuaaaaaccuuaacauacacaaaccacuuauuuaacacagcaauuucaccuuuaagacuucauccuaagaaaauaacuacagguacuaagaaaauuuaauguagaagaauauuuaguguagcauucuuuauaauauuaaauacuuagagauaacaaauguccaaaaagaauuauugcauaaauuuuguguauucccaugaugaaaucuauguauccaauaaaaagcagguuauggaagauaucaugacaucagaaaaaguuggucauuuauuauuuauuauuuaaagacagggucucucucugucacccaggcuggagugcaguggccugaucauagcucacugcagccuugaccuccugggcucaagugauccuccugacucagccucugaauuagcugggacuacaagaaugugccaccauacccugugaauuuuuuaaaacuuuuuuuagagacgaggucuugcuauguuguccagauuggucuugaacucccagccucaagggaucauccugccucggccucccaaagugcugagauuacaggugugagccaccaugcccagcuaggucauuuauuuuuaaguauauuuucucagaaaaaaagaaagacugaccacagaaaaauauuaacaguggcaauauugugguaguggauuuauaauugauuuuauuuuaugggugugauuucuauaguuaaguucacuucgauagacauguguguucuuauagucuggauaaagaagaaauuuaagaugaaaugggagccaaggugaaugaugaaaggauacauuuaaauuagacaaaauuuaaauuuagaugagauucaaauuucaaugagcuucaaaucuucugauccauacaaacuguaucuagggauacaaaaggaacuuccagguaugauuauagacaugcuaugaggaauugcugaggauagaacaaauaccauaugccuaggguugggcaacuaugccaauuuuuaaaagggaaaaugguggauuccagaaccuacagccugauaagcuuaguuugguuagggaaagaaaguugguaucaacgagagccaaccuggguucacuuaaguacuuccaaaccacucucauuuccuuaucuaccaugugcuuuaagucacguaauccucaugccagaccucuaagguagauauuacuaccauuacccccauuucacagaaguggagccugaggucauaaaugucaagugauuugcccaagauccucuagcugguuuaguuuuuucugucgauaauguuaauacguaagaagaugacagacauauuugucauaccugucauuggacacagguuuucaagggaugcuggugaauaauauaauggaccauggaacaguauuauucaguauuauuaguagaugaaauguuuuauuauuacauuuauuacuaauguauuauuaguagauaaaaugauuacacacacaaauguggauuggaugagauggcucaugccuaaaauccaagcacuuugagauagacugaggcaaguggauugcuugaguccaggaguccuaagaccagccuggacaacauaguaagaccugucacuacaaacaauacaaaaauuagcuggguaugguggcaugcaaguagccucccagcuacuugggaggcugaggugggaggauugcuugauuccaggaaguugaagcugcagugagcuauaaucaugccauugcacuccagccugggcaacagagggagacccugucucaaaaaaaaaaaaaaaaaaaaaagguugggugugguggcucacaccuguaaucucaggacuuugggaagccaaggugggaggaucgcuugagcucaagaguuugaaaccagucugggaaauauagugagaccucaccucuacuuaaauaaauaaauaaauaaauaaauaaauaaaauuuagcugagccugguggugugcaccuguauugccagcuacucgggaggcugaggagggaguaucacuugagcccaggaguucaaggcugcagugagcuaugaucaugcaacugcauccagccugggcgauaaagcaagacugugucucaaauuaaaaagugcagauuaauaggacauugcuuaccuggaguuuucuaagcgguaauaauaacaccacuucccaaguacuuaugugcaagguucuaugcaaaaacgcuuuucauucaucaucucaguuaaucuuccccagcagcuggagaaacagguauuguuauccccauuuuacagaugagcaaaccaaggcucaggaugguuuaugaacuugcuuguaaucaccagauagcuagugauuagaagagcucagauucggucacagaaagucugguuucagaagccauaugcuuaacuauuauacuaaaguaucuucuuuugguuauuggcuccuguuaugcucaaauuuuuuuauuaaaagaaagauguauuaaucuugaggaaugacuuaaaaggcauacuucugcuaaggaaucaaaguugagagaaucaaagaaaaggaaggcaagaaaaccaacauuuauugagaacuuacaucagguauuauacugcccugguuucagacucaggaccacuucgcagugcagguaguauuagcccuauuuucacugauaagcagguugagacucagagaucacaugacauguucuagguuacagggcuauguaauaaaaccagaauucgaauacagaucugucugacuccuaaaccuuuccacuuuuuacuacuggcucaugaaaagccaauguaaaaauacauaauagugggaaaaaguguaaaaucuugcaauuggcuuuuaaaagucaauuguguaaauguuagauuuggaagacauaguauaucaacauuucaagugcaaaagaucucaagauuugaguugaucauaaaacaccaugagucagcaguguggcugugagaacacucguacaaucucagguggcauucacagaagcacuguguccuggaaaagggaaagaaugugccuacugguuucuaacugcuuauaccagauggagagaauugugauuaauucugagugccacauuuuaaaagggacuuugacagacuaggguaugguuauccagaggagagcagccaacugguaacaaaagacacauauacauacauacauauauccauacauaacgacuggauuauuucacagaggugaaaugauugggaaagccccagagguggcuggaaaccauucucaguuagcuggagggcugucguauggaaaaaagucuucuuauacuuguguggcuccagaggacaaagcuauguuuggaaggagguagauuugggccaauaaaugaaaaaccaaaggccgggcgcgguggcucacaccuguaauccagcacuuugggaggccgaggccgguggaucacaaggucaggagaucaagaccggccuggccuggccaacauggugaaaccccaucucuaccaaaaauacaaaaauuagccgggcgugguggcagcgccuguaaucccaguuacucaugaggcugaggcaggagaaucgcuuaaaccugggaggcggagguugcaguggaccgagaucaagccacugcacuccagccugggugacagagugagacucugucucaaaaaaaaaaaaaaaaaaaaaaaaagaaagaaagaaagaaagaaagaaagaaagaaaaaccagagcaugacugugccuugcauauauuuuuaggcccugaaguaccaagcccgaugcuuuagacaucacaggcacucaacaaauauauauugaauggaauugauguguugcuguacaaaagcccaaccagcugucuugugggguagcaggcucacuagagauuuugagcagaagcuagauggccacuuguacucaggacucccauuccauaaaauaauuccuacuccuugcccaauuccaccuucuuuccagccuuaccugcuucccuccuggcaacuucaaagacgagucuucacucaagccacuccaggcugacuucuuuuuuauuuuuuauuuuaauuuuaauuuuuuuuuucuuucuuucuuucuuuuuuuuuuuuuuuuuuugagauggagucucacuaugucucccaggcuggagugcaguggcgugaucucggcuuacugcaaccuccgcucccagguucaagccauucuccugccucagccuccugaguagcugggauuacaggcacaugccaccaugcccggcuacuuuuuguauuuuuaguagagaugggguuucaccauguuagucaggauggucucaaucuccugaccucgugauccgcccgccucggccucccaaagugcugggauuauaggcgugagccaccgcgcccagccucuauuuuuaauuuuuuuuauagauggggucucacuauguugaccaggcuagucucaaacccugggcuccagugauccucuugccucagccuuccaaacugcugggauuauaggcauaagccacuacacccggcccagguugacuucuuuuuuuuuuuuuuuaauuugguuuuuuuuuuuuuuuuuuuuuuuuuugagacgaaguuuugcucuugucgcccaggcuggagcacaauggugcaaucucggcucacugcaaccucugccucccagguucaagcgauucuccugccucagccucccgagcagcugggauuacaggcgccugccaccaagcccggcuaaguuuuguauuuuuaguggagacgggguuucaccauguuggccagucuggucuugaacuccugaccucaguugauccaccugccucggccucccaaagugcugggauuacaggcaugagccaacgcgcccggccagcugacuucuaauucucuagaaacugugcucaucaggucuucuaauuacuaagccuuaucuuauaccuggucugaccccagagaaagcuguugaucauuuucucugggaaggucucaugucucuuuccuugcagaccucccucugucccacucucaugccccaucuuuucuccuuuccagucuauugccaggguccuucuccacugacagcugccucaggcuuuuuuucaguguucuucgcuugguccuuuucauuguuugucugcccccaagauauccuauuuauuacgaggacugagccacugaugggcccggacuccugaaccuaugcauucaguccagaccucucuccugaucugcagaccugucauucauuugcacuggauaucccacaauuacugugagcuucauauccuguucagcauccccucugcacuugcucuccuuccugccuuuagcuucgucagugucauugcacuucaaccucggcccgucucuccuacucccaaaccucuaucuaauugauaacugugucuucagugcuacuuuuaaaucccccuuggacuuguuacuacccuucaccccacugcugcuauggugacucagaccuuaaucccuucuuuagacuauuacaguagucuucuaauuggcuuugcuggcucagucuucauccugccacuaaaguuuuuaauuuuuuaaaauaugaaugagcacaucuuuccacucuuuaagaaaugcugauaguuacugucuucaguaucaaguccagauucccuagcuguaaucaagguuccucgcaauauaaccacaacauaccuuagcauugauuucuagcccacaucagacuucucucuuuucuuggaacaguuuucccucuccacaccuuugugccuguuuucauccuauuccucuuacaaaaaagccacucuucucuccuugccaacucaucuccuccuucagugguucuaggaaaagaauccacuuccuguuucuuguuuuuuguuuguuuugagauagcaucuugcucugucgcccaggcuggagugcagcagagcgaucucggcucauugcuaccugcgucucccagguucaagugauucuuccgccucagccucccgaguagcugggacuacaggcgcccaccaccacgcccggcuaauuuuuguauuuuuaguagagacgggguuucaccaugcuggccaggcuggucucaaacuccugaccucaggugaucugcccuccuccucccaaagugcugggauuacaggcaugagccacugcgucuggccucucuuccacuuccgcgucaggaguuuagggacgcaucagagugagaaauaugguauuuaaggcaauggacuggauugacaauugcagagggacaagcccaauggggcugccaauauucagacauugggaagggcccagccaaagagacugcgagggaacaaugagguaggaggcaaccuagugaggugugauggaagauaaggguagaaaguguuuuaucagaaggggugaacauugugccaagagucugcugagaggaguaagaugaagacugugaauuuggauuugaugucauggaggucauugcgagcuucaucgguguguuuucaguggaguaauaggggcaaaaggcugacuggauuggcuucaagagauaggcagaaaugaugaaguagaugcuuguugaacggguaaaagucggauaaaugaagaaauaaugucuucgagaggaucccaugauagaucaugaaccaaaauagauaaaugaguuauucugagucucugaaaaacuccugaguagaaacaaugaugugauuucagggugcaaagcuuugcguaagugacaagggaauucaggugggauuacucaggcaguagggugagucuagggagggcuguuuaugaguucuguugugcuugcaauuuuaucuccuccuggccucaguucaugaaggccuucaugcaagacuucucagaggggggccucagggacgagcugucccugcagggacuuggguguaggauuuugagagauuauuuucaaacaccucuugcaggcaugugggguuccugagaauaagccuuucaggcugacuuccgcccuuuuuggggagugagcagcaccaagucugccuggucaggaagaggugaauguggaaaaccugauccauccaacauaguguauuugaaaaugcuguacuucaaaauguuucucuauaaaaauguuauauugaaauaauaauggagauggaccaaguggucgccuagauuugaugaauaagcaggcuguuuauagcaguuccccacuggaguacaacaguaaugaaguaugaagaauacaaaccuggguagaccagacccagacuuugauuuuguguuguucccugugucauuuuccucaaauggucaaagcuucaaaaggcacuuugguaccgauuccauauagaauguguuuuuacuuacaugacugaggacaauacauuucccuucauagaagcauuuuuggggauguccagggcccagacugugaaacagaaccagccauaaaguaacugaacaacucccguugcaccacauguccugccguucuccaaaugcauugucugcucuuauuuguuggugucuuugcccacgcuguucccuggaacacccaaaugcccuucguccuggcaugcuuagcucugggaggaccuucugcaggaggccuuccucacccacucauacaaagacagagccccaaaccacauuugcguguaguucaaucgccacaccuaccacagugaacuucagugguuuucucuucuggcuuucccauuggacugugaguuucuugaagccugugacuuugucuuaauucugggguuccuagguuauuuuuuugcaugccaccacacccagcuacggggucucccuguguugcccaggcuggucuugaacuccugggcuuaaguaauccacccaccucggccuuccaaaaugcagggguuacaggugcgagccaucacacuuggcccuugauccuauuucuauccugugcaucuagaauagcgccuguacaguuugagcacauuaucguguuuauugaauaguugcaugaaggcuggagaguguggaugaaugaauauauaaaaagaucagaaaaauguuaccccccaaauugaagcuaauaaaagaaaaagagugucaaugacuuuacauauaugcagaauuuguaccuauaaugguuuuuuccacauccgguugagacaagauuauugcaacguaauguguauggaaaggggagugauccauccugugacuuguacuguguguggcacaagauuguggaaucaugcugaugaacaucagaguuggguaguagggauugauugguuuaauucuagauuugugagagagaugugaucugugaacaugaacuuuuuuuguuguguuuugguuuuguuuuuguuuuuugagauggagucuugcucuguugcugaggcuagagugcaauggcgcaaucucggcucacugcaaccuccaccuccuggguucaugcaauucuccugccucagccucccaaguagcugggauuacgugcaugcgccaccauacccggcugauuuuuguauuuuuaguagagaugggguuucaccauguuggccaggcuggucuugaacuccugaccucaggugauccaccugccuaggccucccaaagugcugggauuacaagugugagccacugcacccggccagaacacaugaacauuuugguccuugucuugucuuuucuuucuuucuuuacuuuuuuuuuuuuuuuuuuugacagaguuucacucuucuugcccaggcuggagugcaauggcgugaucucggcucaccgcaaccuccgccucccggguucaagugauucuccugccucaaucucaugaguagcugggauuaaaggcaugugccaccacgcccagcuaauuuuguauuuuuaguagagacaagguuucuccauauuggucaggcuggucucaaacuccaaaccucgggugaucuacccaccucugccucugccucccaaagugcugggauuacaggugugagccacugcgccuggccagaacacaugaacauuuugguccuuguuauuucuuuuaagcaaaauauuuuuucuuuuaaaauuggagcacaagguacaccuuaauaaauauguuuauuugaagcaucauuucauuauucacgguuuuuaaauuuuucauaaaaaauuuuaaaaauaaaccagccguaacaccucugaaguggaaguuacacugaaccaggcauuucauuuccaggugccuuggucucuuucaugcauaauuuguaaaaugauaauagcccuuacuaguauuuacauuguaaaaguguuguuacuguaaauuagauagucuaaaauggguuaugaugccuucuuugaaagacaagcauuacacacaaaugagguauuauuauuuaguuuugccuuuucaagcucguuaaaugagaauuagaugaaaacucugcuuuaagcaauauucagcggguaagugacuauugacuugagugaaaugaaaaaaaaaauucuucagcugaaaacucaguuuguacagccuugccuaucugugcacaggcagaaauaguguauuuauaugugauguuuaccaauguucuuuaucuccucucugugcuauaaucaaaaacugaagacaguuaagccuuucaguucagucauuguaugcgucuuggaaaaccuaagucaucuggaaugauuacaacuuagaaauaauguuuccacgaaucaagucaugcugcuagcuuucuuacugauuuagggccuaaauuaacugugccaggccuucgcuuccacuccugguucuuaggaugggggaccuauuccugcaguguuucagguuaguuaccacuaaggccuaugugcaccucauuaucacccccaaccaggcccagggcuuuccuaucuucuuccuggaauacagggauaggauggcaggagaagggguguuuggaaauaauauuugaggaauuguggauaucagaaauuucaugggaaggucugaggucugaaacaguacccugggaggauucaggguaacagagagccgguggugagggacccauccguacagcaucauuguggccucuguguggucuauuggcucuaacccauuuuuggccccugcucuuggacuccccccgucccuccccucucauucaaaccccuucugguguccauccauuaggccuugacucaccuucgcuccccagggccaaccuucagcauugcuugcaguuauagucaucugcuuuccaccugacccauuuauuuuggcuucuggauuuugcuccuagagaggcccccugcuuggauagcugccuggccagcugcagagccagcuguuuguuccagacuccaaggugacuacacuccucucuucucccucugacugguccugauacaugggcugugacaagaagugagagauagugacagugugacaauugugucagaacagauucaucccucuguaggucaucucagcaguggacugcucagaguucagguacacauucaugcuucacagugggccauggaccaggaagucuguguggaccucagaggccuagggacagggguggguacagaagaagaguuaggaggaggacacaaaaggcuaauuugguuugcucugcaguuuuggccaagaccaguacugguuuuugggcuacuguucaacagacaggccauguccuucaagagcauuggcaggaggucagcugagcugacacgcaggugguaagggaccucagagauccucugaggugagccuaaugguggcccaccuuccuugcccuugcaaggaaauuuagggauuaugucuuccacuuuuaaggcaaacuuuuugaaacaggugucugcauccauugguuccauuuacucuucaacucacucugaccugacugcugccuccccggacccugcucucugccaaacuggucagauaucuccaugguacucaccugugggugcuucuuagucuuuuucuugcucgaucucuugauagcauuugccuuuguggaccacagccuacuccuugaaacaugcuuuucccuuguucucuggauaccucacaauucuuuuuucccuaccucacuggcuacaccuucucgcucuuuuuuucagggguccuuucucugcucaugucauauagcuuggauauuuguguccuccaaaccucauguugaaauuucauccccagcauuggagguggggccuggugggagguguuuggaucauggggguggaucccucaugaauggcuuggugccuuucuugcugugaugagugaguucucgcucuauuaguucacaugaacacugauguucaaaagagcaacaccuccucuucucacucgugcucucucucuggccaugucaugugacaugccugguccccuucaccuucugccgugaguaaaagcuuccugagaucuugccagaagcagauaugacugccaugcuucuuauacggccugcagaacugugagccaaauaaaccuuuuuucuuuagaaauuacccagcuucaggcauuccuuuuaagcaacacagaaugaacuaacacaccauccuuuuuuuuuuuguuuuguuuucugagacagagucucgcuuugucgcccaggcuggagggcaguggcacgaucuuggcucacugcaaucuccgccucccagguucaagcaauucuucugucucagccucccgaguagcugggacuauaggcgcgugccaccaugccuggcuaauuuuuuugucuguauuuuuaguagagauggggcuucaccguguuagccaggauggucuccaucuccugaucucgugauccacccaccuuggccucccaaagugcugggauuacaggugugagccacuguaccuggccuacaccauccuuuauuuaagcuuugguguuauucugucuucucucuuuuucucugcuccuacacacccucccagggcaucucauucaucgcugugaagucucuuguugucugucauguauagaugacuccuaaauggauauccuccgauuucuagaucaaacugcuugcuguugcucugaauguuccccagucaucacaaaacaaacacgucaaaggcuuaacucagcaccuucucuccaaaaucuccucaauuuccucuucauauuuuugcugucuuagugaaugauauccacuauccaccaaguugucuaagucaaaaaccugaucuccaguccggacuuugcccucuucaaaacuccaacauguaaucuaucacgacuuucaguagauucuaccuccucgagaauguggcuuguacauuucuccauaauuuggugcugcucaccuuuccagucucaucucugaccacucugagacucucuaaacuacuuuuaguacucacauacucagcaugcauaaucauucauguucuuuccaaaauguacguauguugugcccuccacccaaaacagacuuccccaccucuuuauuugguuaacuccuucacaccuuguaagugucuguguacaagucacuaacuuccaauuuucccuaaaucuggguuagguuaccuccuagggcucucaguacuuaucucuucauaacacgcuucucuaucacagcugacuuuccuguuucuaccgugcccuguccugugagguuccuguaagugcuuacggggaccuuauuuuuucuauucaccuuuguauuccuaacaccaacaaaguauuugguacaaaaaacagaugcucaagaaaugaaugaaugugaaugucaaagguaucauugugaaaauauaaauuaaauuuccggcugggugugguggcucacaacaguaaucccaucacuuugggaggccagggcagcaggguugcugcagcccaggaguuugagaccagccugggcaacauggcaagucucucucuacaaaaacaaaaaaaaggcagggcacgguggcucacgccuguaaucccaacacugggaggucgaggugggcagaucaccugaggucaggaguuugagaccagccuggccaaaauggcaaaacccugucucuacuaaaaauacaagaaacacauuagccagaugugguggugugugccuguaauuccagcuacucggggggcugaagcaagagaaucgcuugaaucugggaggcggagcuugcagugagccaagaucgcgccacuguacuucagccugggugacagagcgagacuccauuucaaaaaaaaaaaauuaaaaugauaauaauaauuuaaaaaaauuaggccggucgcgguggcucaugccuguaaucccagcacuuugggaggccgagacgggcggaucacaaggucaggagaucgagaucauccugguuaacacggugaaaccucgucucuacuaaaaauacaaaaaauuagcugggcguguaggcgggcgccuguagucccagcuacucgggaggcugaggcaggagaauggcgugaacccgggaagcagagcuugcagugagcugagaucgccccacugcacuccagccugggcaacagagcaagacuaugucucaaaagaaaacaaaaaaggaauugcaagcagagggcaauuaauagagguagacuucacaucugucccuugugggcuucuuuuccagaguuccauauccagacucucaaaccauguuuugggaucauccaaacauuccauccuccugacuccauaaacuauuggauucauaaccugcuccaugcuugaaaacauggggauuggaauucgguaaguguugauguuuuaguuuuuucuuucuuuaguugucaaaaaaguacuguaccuauauaguaaugcuuuucaaauucuucucucuggagucuucaucagaagaugugacuggaguccucacuagucuaguuguuuucacaauguuugaauaugcuauguguacaaagaaauguugugaagucuucugaggaauuccauccuuucacauuuucuccucuguuucaugaguauuuaaauucuuuggcugggcgcaguggcucaugucuguaaucccagcacuuugggaggccgaggccggcaaaucacgaggucaggaguucgagaccagccugguuaacauggugaaaccccaucucuacuaaaaauacaaaaaauugcugggcaugguggcaggugccuguaauuccgcuacuugggagguugaggcaggagaaucgcuugaacccaggaggcagaaguugcagcgagccaagaucgugccacugcaugccagcccaggcgacagugcgagacuccaucucaaaaaaaagaaaaaauucuucaucauugcucuauugauauuuucuaaagugacuucacauagagaaaaguggauuuuuggcugggcacaguagcucaugcguguaauccuaguguuuuggaaggccaaggcagaaggauugcuugaggcuggaaauccaagaucagccugggcaacauagcaagaccccaucucuacaaaaauuuaaaaauuaucuaggacuacagguggcaugugccuauagacccagcuacuugggaggcugaggcaggaggaucacuugagaccaggaguucaaggcugcagugagccaugaucacaacacugcacucuagccuaggcaacagagcaagaccuuaucucaaaaaaaauaaaaauaaaaauaaaaguggauuuugagaaucagaaagacuugcugcccacucugggccaguuuaauaaugcaggacauguguaguucaaccauacuccaaaaacaacucuguuuuagccauacugccuaucgucaaccccacugcauccccacugucaaauuucucuagccccauaacugauuuuguuuuucauaacacuucuuuguuuguugucuaccuccuuuccuagaauguaagcauuaugagggcaggcaauuuuuuuguucagcacuagaugcucagcacuuggaacaguaacugguacacagaaggcacucaguaaauauuuuuugauugaaugaaugauguauuuuaaaaguuuuucuuuuggccgggcucaguggcucacaccuauaaucccagcacuuugggaggcugaggcgggcggaucaugaggucaggagaucgagaccauccugugaaaccccgucucuacuaaaaaaaaauacaaaaaauuagccgggcgugguggugggcgccuguagucccagcuacucgggaggccaaggaaggagaauggcaugaaccugggaggcggaacuugcagugagccaagaucaugccacugcacuccagccugggugacagagcaggacugugucucaaaaaaaaaaaaaaaguuuuucuuuuuaauuuuuauacuuuuaaaaauagagaugagguuuugcuauguuacccaggcuggucuugaacuccuggccucaagcaauccuccugccucaaccucccaaagcgcugggguuacaaguacauuuuugagccaccacaccuggcccuuguguuuuguuuguuuuuuucuuuuuaaagaggcugaugcaggccggguacaguggcucacaccuguaaucucagcacuuugagagggcgaggugggcggaucaccugagaucaggaguucaagaccagccugaccaacguggagaaaccccgugucuacuaaaaauacaaaauuagccaggcgugguggcacacgccuguaaucccagcuacucaggaggcugaagcaggagaaucgcuugaacccgguaggcagaaguugcagugagccaagauugcaccauugcacuccagccugggcaacaggauugaaacuccaucccccaaccagcaacaacaaccacaacaacaacaacaacaacaacaaagaggcugaugcauauucggaucuccagggaucuaaugaaaaucugcuuuuuccccgaacacuuauaucgaugacuaagacaauaacauugauggccugccgaacaaauuuacagaugacacacacuagaaagaauuacaaauagguuggaggauacaaucagauucucuccccacccccaauccugacaaaauguaauaaugaaucauaucaaacaauauagaguuuaauguguaccaauauaaaguacucaaagauccucgaauuguacagguacugagugggggcgagguggcuuacagcuacacacggcacgaagauuuacagucuccuguugauuguaagaagaugagucaacacagugggauguagcuuuaaaaaaaaaucaaucuuuuguuguauuaauagaaauguaacguucgagaggggaacuaguucucuaguacucacugaugaucagaccacauuuauuguguuuuaugaauucugggcuucagacauucagagacauugaucaacaaaggauuauaugggaaaaauaaaaaugauaauaagaaaucuggugcacagaguuauucagaaauaacaaaaagauccaagguuuuauguagguguguaagggggauggugauaacuagcauauguagcuaccuuucaaaguuugaggucuauccggcagaggagagauuugaucucuucuggguaaucccaaauggcagauugagggccaaugaguggagauguaagcacguacauuucaacccauuaacauuggucaacuguuagauuugccuagcagacaaauggacaaccacuggagguaguaaauucccugacccuggugcccggaaguggggcagucaugccccauucacuggguacauuugugacagaaguucaaacacuagagugaggaagugaggagaauagauuuguuuauaauagcaaacacauagugaguguguacuguauggcaaacaccauaauacgugauuaaugagguugucauuucuaauacaucaaucccacuagcucauuuuacagaugagaaagugaggcuuagagggauuaagcaauuugcccaaggucuuacaccuugguacaaagcagaucuaggauuugaacccaggcagucagaucccaaaccuuaauuauuauucuaugaggacccuaaggugggcauggugguacacgcuuauagucccagauacuggggaggcugaggcaggagaaucacuagaauccaggaguucaagacugcagugagcuaugaucaugccacugcacuccagcuugggcaucagagcgagacauugucucuaaaauaaguaaauaaaaauaaaaguaaaguauaaggacuuucacuucuagaaagccguucuuucccaccuugagauccuaucacucuaaugaaauaaucaaaccgaggaguuuaucucaaaggguggaugauucuauaguacauagauucccucuauauguaauaugcaggaacuguauuagucuggccauuugccacuuggguauacuguauggagcccagcauaggacuuggcacacaguaggugcuugcuaauuauuuauuaagugaaaagaaugaacaaaugcaacaaauacaacauuggcgggaucugaaaugacagaaccucaauauauugugccugaagaaaagcacauuucuggguggucuacugaggacccucagcaaaagugauaauccgucacucccggcaaaggccuugagaauuccugugcaauuguuugaacaauauucauuuaaacaaauauuuauugaauacugguccuguaccagguauguccaaugugugaaggaugcagaggugaauuggaggaugugcugucagugggggagaagacaggugggcaaauccuuacaguaccuugugacaaaugcuauagcaguugcguguauguuuuuuaaguaugauggaagcaaagaacagaaaggaaaugauucugcuagguuaaaggagucaucugauauuugauuauguuuuauuuauuuauuuacuuuuauuauuauuaauuuuuuuugagauagggucucccucuguugcccaggcuggagugcaauggcacagucucagcaaccuucaucuccuggguucaagcgauucuucucccucagccucccaaguagcugggauuacaggcgccugccaccacacccagcuauuuuuuuuuuuuuuuuguauuuuuaguagagacaggguuucaccaugucaugcuagucuugaacuccugaccucaggugauccacccgccucgaccucccaaagggcugggauuauaggugugagccacugcccccagccguugaugaugucuuaaaaauagcuuccacauguauguuacuugaguuuauucagucuucauaaagaccaugugagauugugaccccuucuuguacagaagaugaaauagagucuuacagagcuuaggugagcuccccagggucauauagcuaguaauaauaauugcccacauugauugaguguuuagaauaucugcgacucuguucuaaaccaucuuaagacauuuaaucuucuaagguaguuauugacaucaucaccauuuuauaaauaagaaaaccaagucacaagauuuaagagacuugccuacagucacauagcuagaaaguggaaaaccaggauuuccacccacacagucugacuuuagcaggcagacacugauccacugcacuaaauugccuugucugguuccccaaagagcuggaacugacacacuuggacucugauuccaaguucaguucucuuucaagugacccugcucauuagcagauacugcauccaaaugagaagaaauggucauguggauacaaggaggcuuguguaguuccugcaucugugguauggugcuguggugggagggcuauggugaagucuguaacaugcaugaacuuaagcacugacaagcauuauggcauaagcuuuagauuuucuauguuuuagguauucaggguuuuuucagggcagucagauuuuuuucuuucguuuuguuuuugagacagaguuucgcucuguugcccuggcuggagugcaguggcauaauuaugggucacuguaaccuggaacucuugggcucaagucauccucccgccucagcuucucgaagagcugggauuacaggcaugaacuaccacaucugcagaauuuggccuguucuccaggccagcauccuaggcucuauggacuaugacuuguuacucauaggaacuagccaccaacacuuacccugcagccuuuuggcugguuuaaauuuuucuaaaaagaagacaagacauaaaacauuaagaaugaaacaaguuaaauucaauaccuauauauuaacaggaauggaauaccgaaauggagaaauaaagcacauaauuguuuaaauugcccagcuuucucuccauaauaaaaauuauuggauugaaaaaccauucagggauggacacggugacucaugccuguucucccaacacuuugggaggucaaggugggaggaucacuugagcccagggguuugagaccagccugggcaacauagcgagacccugucucuaaaaaaauuuagaauuagccaggcgugguggugcacagcuguagucccagcuacuugggaggcugaaguggaagaaucacuugaaccccaggaggucaaggcugcagugagccacgauugugcaacuacacuccagcuugggugacagggugagacccagucuccaaagaaaaaagaagaaaaagaaaaauaguucaaucuaauauuauugugccuuaacaauuaaguuggucuggcucuguggcgaaucugagaaagaauugguuuuuaaaacgaaugaaggaguuuccuucuucuuuaauaauuacuacuuauauuaauguggacaugaccuauaugaucgaagauauugugucuuuaaaauggccaucucucagaauuuuuggagauuuggucauuuuaaaaucagucgcaggcucggauuucuggggcaggcgguggggcagaaaaggucaguguuguuugguauucaacgcaggugggguuuugguauggcuugguuuuuggcauuuuguuuugccauuuauggagauuuaguagauucaacugauuaucuuggccuuuguguuuguggauuucuauuuucuuggcuucaguuccuuggaaacguuuguuuugaugguggcaggagagcugguuuagucauguuuuauuuuuguuguuccuauuuauuucuaauauccuuuacuucaaguccacuuacaaaguaucauguaaccugucuuuaugucuccacaaaugaaauguuccuaguagcaacucuaguguaaccuuauaggaauaguuaauuugaugcccaucgagaugguucuguaguauuagaacaaggguauguuuuggaaauuauguuugaaauuuaucauuggauuuagcauuuagcaaaugaaauuucaagugucugagaucaacaaguagccauauucauauaaacauauuuuccuuuucauugcugagucaacaaaaguuggaaaauuauuuucucacacauauuccauucuucaacuaaaccugaagguaaauuacuuuuaaaaaccacauuccaaacaaacaguuuuucauaaagcuaugaguacaugaauagagugggccccacuggcauuugggauguacauguaauuagaacucucaguuuuucaaacauguaauuuacuacaguugagguuuuuaauucuuaacuuugaguccauugggaugaaacaagugacccuuguuggaaguaugucaagaaucaacuuucucagguugaccuuuaguuugcuggucaucaaauuaaaacacuguguauucccaggcuugaagauguuggaagcuuccuaaguuuguuaaaagaucaaggcagaaggcuagcgcugcuuugcugcugugaagaacagacuucccucuuccuucuccuuuaaguugguuucugccugagagagagcaugcuccaccucagcuggccccgucuuugcucugauaguugccuuguacuuguuuucgcaacuagauagaugucuaucauccuuugaacugauuugacauccuuucuaguacaaggcucaguacuaggcaccaaggacuguuacaaacgcucucaaucaccauuguucauaacuuaaaaguggcaacaaaaucuggaauaacucaaugacugcgugaccuugagcaagcaacuuaaucucucucuaaaauaaugauuucaagccuaggcaacauggcaaaacccugucucuacaaaaaauacacaaauuagcugggcauggugguaugcaccuguagucccagcuacuaaggaggcugaagugaaaggauccccugagcccaggaggucaagacugcagugagcuaugauggcaccacugcacuccagcuugggugacagaugaagacccugucucaaacaaacaaacaaacaaacaaacaauaauaaaauagcuauuucacaaagucauuguacuaaacacuugggauugcauaugaaaauacuuagcacaaagcuuggaacauaauugcaaguguagauugaguuuaugugcaguauauaauaauccauggaaacucaaauggacagauggacccaaaucaaaauugucugcuucuagccauuuguuaaaucaaagcuucacuuucaaaugaauaacuaaaucuacccaugauuucucuuuaaagucuacauucagagcaaaaaagugcuuccaugauaaucuguucauagauuucauaacaggagcugacgaggguuuauuuaggagaaaacgugaacaagcagaagaaggaagauuagauaaauaaaaugucuuucaaaauaaaugaagaagggacaauuaucugauaauagaacauucagauggugauguaauuauaaaauagacuuguuuuuguaagugguuuaaaaaauguuuauugaccuuaaaggaauaacuuuuucauaauugaaugauaaaacaugcaguaucuuguauuaacuaguaauaaacuacaaauauccguuaacuauauuuuucuuuaagugcaucugcugucauggccuuacauuuauuucagugauacaaaaagagugauuugauuugauaacugccuguccucucugcauauccgaaaaucggaaggagcagccuucccucugacucacuuagcugugaaaauaggacucugccaaauuacugggaacuaacacuguaguaaaaccauaagaaaauuuugcuaagaaaccuuuucucaucugcaaauuacuugacugaaaccugaggugcuggauuucagcacaaaggugacuuuggaggggaaauuuugugccaaacuggaucuguuguuuuuguguuauguaaaaaggagaaaaaaaaugaacuguuuacuccuaagcuauaaauuuaagauuauccuauuacaccaaaugacagaauuuccgaaccucaaaccuuacuuuagagcuauauuuucauaaacuaugaucuguacccaaucaaaacuagauguaauugaauguuaaauaauuagccuugcccaauuauauuuaaagaguacuggacaaaguuauuuuauucacugcaucagaagugaauuauaguugaauugcagaaauggcaauacaugugcaguauaaaaauauagaauacagaguaguaaaaagaagaaaauaaaaaucaccaagucacccauaauucuaucacucagagauaucaucauuaaaauuuuguuuuaaauuuaugcacgcauacaaacacacacaugcacacucauacacacaccagaauauucacgauauauaaaugcauguuaaugguuuauuauagaaaagugaaacauaaggaaaaguagacagaaagcauaaaggaccccaugucaaguuggaccucaugucuagcccaucaauaucccauuccucuccccaucucauuuuauuuugaagcaaguuccagauauuauauuauuucauccauaaauuuugauauggcugggugugguggcucauuccuauaaucccaacacuuucagaggcuggggcaggaggaucacuugaggccauuaguuugagcccagccuggucuacauagcaagacuuugccucuacaaaaaauuaaaaaauuagcuguaugugguggugagugccuauaaucccaacuaccaggagaauaaggugggaggaucauuugagcccaggaguucaagacugcagugagcuacaauugugccacuguacuccagccugggugacagacugagacccugucuaaaauguauauauuucaauaugaaucuuuaaaagauaaggacuuguaaaaaacauaaccauuaucauaucuacauuaacuaauacaauuuuuuaguaguaugaaauauucaguguuggaauuuuaaauugucuuacaaauuuuauaacuuacuuuuguuguuguuguuguuucuuuuuuucuuuuuuuuuuuuuuuggagacggagucucgcucugucacccgggcuggagugcaguggcaugaucuuggcucacugcaaccuccaccuccuggggucaagcgauucuccugccuuagccucccgaguagcugagauuacaggcacgcuccaccaugcucggcuaauuuuuauauuuuuaguacagacaggguuucaccauguuggccagggugcucucgaacuccugaccucgugauccacccugcucggccucccaaaguauaacuuacuuuuguaguuugcuuguugaagcaagauccaaauaagguucauacacugaaguugguugauaugucccuuaaaucucuuuuaauuuaaaucccuuaaaucucuuuuaauuucauuuuuuuccucauaacuuauuuguugcaaaaaccaaguuguuuguccuguagaacuucccacagucuggauguuucugauugcauuccuaugauauagcucaacauguuccucuguacaggcuuaaucagauucauauauauauauauauuuuuuuuuuuuuuggcaagacugcuuccuagggaguggaguauuuugccauuaggugguacauaaaaaucucuucuuuugugauguuaccuagauccauuaguucauuaaggauuguaaaaaugguaauauuuuaauccuaucauuccuuaaguugauuuuuuggcaugugccaaugguguuugcuuugucuuauuuuuaaguaacuuuuguuuucucuauuguaauuauaauuugaacucauucauugaaauguauuuaaugugcuucuguacauauuauuuauuauucuuauuaaugcuuaaauuauccucauuggucugugauagcaucuucaaauugguuccugacaucuuuugacucaacccaagcaguuuuugauagcuuuccugcuauuugguacaagauggcauaggcucaucuugaauauuuccacauaguagaaauuacuuauauuuaagaugugaauauauauacauauaauacaaaaccuuagggcagaaacuauuuaugauaccaaaagaguagaaauaaccccaaugucuauuaauggaggacugguugaauaaacuaugauaccuacacacaauggagucuguguagcuacaaaaugaaaguagguuuuuuuugguuuuuuuuuuuuuuuugagaaggagucuugcucuguugcugaggcuagagugcaguggcacuaucuuggcucacugcaaccuccgccuccuggguucaagugauucuccugccucagcuuccugaguagcuaggauuacaggcgugcaccaccaugcuuagcuaauuuuuguauuuuuaguagagaugggguuucaccaggcuggccaggcuggucuugaacugcugacuucaggcaaucugccugccuuggccucccaaaguacugggauuauaggcaugagccacugcaccuggccagaaguaggaucuuuaaauauauuuauuauggauugaucuguaggauauauuacaaaaaaauggggggaggaaugugagucuacgaugcuaccauacaggucagaagggauauauauguaaauguauauacauacacgcauauaugcaugcauacacacacauauguaaauacauuugcuuauauuagaaaacaaagaauaggaggauucacaucacaaaauauuaauaguaguuaccuguaaaaaauggaggaaagaaaguggaggggauagggauagaaacuagacuucuuagaauucaccuuguuuuguagauuugacuuuggccaggcuggucucgaacuccuaaccucagaugauccacccgccuuggccucccaaagugccgagauuacaggugugagccaccgccccggccuaauugugguaauucuaaucuuacuaugccugcuguccuugagaagcaggauucucagcaugagaggaagggaauauagauguaacauggaggagguuaggcagaaauccugugguccugaauuugaauugagaguugauauaaauuuagggugucuauguacauguauagacaugucuccuagguccucuguucacugaaaaaccuagacacaaugacuaagccagaagcaaugagcacucuuguuaucuauauuaugauaugauauaugauauacauacacauguaucauaaauauauauucauauauacauaaauuccauguauguguagcaucaauuauuuagcuauucuucuauuucuggucauuuagauguucccaauucuuuacacuuauauauaauaaguguggcaaagcaauuguguauuuaucauuuccuucauacacuuuuuuguaaguagaauuacccgacuagaggguaggaacauguuuaaacucuugauuaguuuugucagaucaccuccagaaagguuauaccagguuacaugguaaguggcagugggggagagagugacugauucacugcauuaauaguuauagacauuuuagacauuuacacugacauaguucugccaaucuaugucagguagaacugugccuuuuuuguuuuucccuuuuugauguucuuauagagaaauuuaaaaaaucaauaauaccauauggaaaaauuacacugcuguaacauuuucauauuuacauuaauaacuguauauuuggcuccuuaaaaguccuacuuauuugcccuuuauaucucaagaaaauccugcgaagugcuccuuuacuuguacaauuuuauguguauauggaagagcuauuucaucaccaagcuauucugcauuugaaacgaaggaggaaauaguuuaucccuccaugaagugguauugacaggaagcaauccacaaagauuagaaugggcuugucaaacuuaauguauuccuuauaauuaaugcacugaauuauaaauccuuuaguuguaaacauacauauaucgugaauguauuaagaucugaauuuuuauaucuuuuugguaauuuuggcagcuaucuuugaaauuccugggauuuuuuauuguaaccuuaccuucacagaacucauuauaugugaaacuuuauuuuccaaacauaguuuaggaaauuaacuaacuuuguaaacacuauuuuacauguaccuucuauauacaacugaaccaugauuaugaaagaaaaaaaaaguagauuauaggcaaaaucauagacuguuacagcuagagcgaucuuaaagaucgucuggccuaaccccuucauuuuauacuuuagaaaacgaagacaaagggcaguuauguaacuucauuaaagucauacagcuacuuugugagagugugacaaaaacccaaacugauaugguacagugucuccuuuccacgucgcuucucagaguuagcaaaaguugaaggcaauacgcaaaaccaaaaauaauugucguguuagggaaaugggauuuggcgugucuaccuucaaaauuugauuaugucacuuuuuugauaaaaauucuauagagaauggaucaacaacuacauuauaaaauuagguaaaagagcaccuuuguuauuugggaagcuagaaauaaauuauggguuuuccaauacuuagcagggauuuguagcaaucaaaaugcagacaaucagugacuuguuagggaugcaaaagucauugcggguuuugcuauuauuuuaauagcaaaaaaugcaauuauuuuugcaucaaccuaauacaauaguuuaucaugauuuuuugacuuuacaauggugugaaagugacaaguauucgaccaggcgcgguggcucacuccuguaaucccagcacuuugggaggccaaggcagguggaucacgaggucaggagaucgagaccauccuggcaaacacggugaaaccccgucucuacuaaaaaauacaaaaaauuagccgggcguggaggcgagaucgcgccacugcacuccagccugggugacagagcaagacucugucucaaaaaaaaaaaaaaaaaaaaaaagaaaagugacaggcauucagcaggaaccauaugucaaauuuggaaucuucaucuuuuccugggcuagcgaugugcagauacuacucucucgugaagcugggccaaaucaccuaacgcaaagcccauuuuauaauaaaguguugaauuucucauguaauuuacugacuacuguauugcaaguguucugaacauguuucagguaggcucugcuaagccgcgaugugcaguagguuaaguguauuacaugcuuuuuugacuuuuguuauuuucaaccuacgauggguuuaucaggacauaaccccauuguaaguugaggagcaccuguacacagcaucugagugcuucauguauguauucauaggcacuguuuuaaguacuuuguuugcauuaucuugaugaguucuaaccauaaucucaaggacagagagagugugugacuugcccccagguaaucuuaagaaugucagacucaagauuugaaccuaggcagucacagacacaguggguuauuugaaguuucaagccucaacugucauugucgccgcuacugaggguugcugugguugucuaacuccccccagcugucuuccuacaggaucaaauguucuacuugagaaauucuuacauagccaggcaugauggcuuacgccuguaaucccagcacuuugggaugcugaggcaggcagaucacuugaagccaggaguucaaaaccaguccgggcaacauggugaagcccugucucuacaaaaaauacaaaaaauaaaauaaaauaaaaauguagcuggguguggcagugugugccuauagucccagcuacuugggaugcugaggugggaggaucaccugaacccaggaggucaaggcugcagugagccauguucacaauacugcacuccagcccggcugacagagagagacacugucuuaaaaauaaaaaaauuccuuagagcaaaaauuuuuagagacagucugccuucaccugccacuugcuauaugauuuuucauuccucaucuguaacauaggugugauaucuaccucauagaauuguuggaggacuaaaugagagaaaucguauccauuuuuugguggaauagcugacacacaguuaucaucagcuauggucaucauuauuaguauuauuaauaucaucaccaacauuaucauuauuguuucuuucucuccuuuugaccucuuuuuucaugcaaaagcuccugaaaaggauaauacauuacccgagaagcuggugacucaucaguuguuuuuuuccuaacagaagagagcagagagguauuaaggcagaaggaaagaaagagguagagagaccucaaagacaacuuagagcagaguuuuaccccaaauuaguugggauacauuuacaaaacaguucauuuggagucuagucucguauuuggcaucuguaaucuuuauuggguuuccggagccuauuaaggaaugagcaagggcacugcuagcaguggugacagaccuucugucccugcccgaggaaucccguccacuguggccaccugccuauccaugcugcagugggaagugggcaacaauccuccgcaagcucuucuguuuacugugccuggaaacgggcguuuugccauggaaaaauuucucauuguacccguaaguacagaacacauauugcacaauacgaaagaucuuauugagacuucuuguuaggccaggcgcucaagccuguaaucccagcacuuggggaggcugaggcaggcggaucaccugacgucaggaguucaaaacuagccuggccaagaaggcaaaacccugucucuacuaaaaauauaaaaaaaucagcugggcaugguggcaaagucccagcuauucuggaggcugaggcaggagaaucacuugaaccugggaggcagauguugcagugagcugaggucacgccauugcacuccagccugggcuacagagugaaacuccaucucaaacaaacaaacaaacaaacaaacuucuuauuaaccuguguacauacugugcuucaagaguaggacugagugccauuccugaggugucauuccacucuuuacucagggguuaaaagucuaaaggugacccgcagucacauccucacuuuuuucucuagaucacacacuuuccacugaugccuaaagucuuacuguuuaaugccaccagcuucucccucaggucaaguauucuuauuuucuguauuucauuuuucacuuuucaccuuuaugaaaaggacugagcacaugguagaauagaaaauggugcaaaaacuguucagugaaaggugcaucucauuuccauccaggcugcccagugccauuggccagaauugccaaccauuuguucauucacucagaaagugugauggggugcauugucugugcuagccacuguuuggggugcuuggaaucuagcagcauacaaauagauuagaucccugccuucuaguagggguugaugggcuacaagcaacauauaugagcaaguuauuauaggguagguuagaaagugaugaaugcagccugggcaacauggugaaaccuugucucuacaaaaaaauuuaaaaaaaaauuagcugggugugguggcacaccuguaguccuagcuacuagggaggcugaagugagaggaucgccugagcccggagguggagguugcaguaagccgagaucgugccacugcacuucagccuggacaacagagagacccugucucaaaaagaaaaaaagaaaaagaaagugacuaaugcuauggacagaaauaagcaagggugggggacaggcugaucagguucacuuaugaaauaucuaucacacaagcuaaguguccaucaacagaugaauggauaaagaaaauguggauacacacacacacacacagacacacacauacaauggacuauuauucagccauuuaaaaaaugaaaucaugucauuugcagcaacauggauggaacuggaggucauuuuguuaagugaaauaagccaggcacagugagacaaauaucaaauguucucacucauaucugagagcuaaaaauguggaucucauggagguggagaguaggauggugguuaccagaggcugggaagggaagggggagugggggaggaagggauguuggcuaauggguacaaacauagaauuagauaguagaaauaaauuauaguauucagcaguacaguagggaaauuaaaguugacuauaauuuauuauauauuucaaaauagcuaucagguuucaaaauaucacauguaccccaacaauauguacgacuauuauauaucaauuuucuuaaagucauaaacauuauaaugggaaaaaaaauaguauauaccacuggccagaaauucuccugagcacuuuacauauguuaacuaucugaauccucauaacaagcccaggcacucuuaucaucgucauuguaaagggaaacugaggcacagaagagguaggaacauggcucaaagucacaaagcgaaugaguaaugagaccugggcuuucacacaggcugccuggcuccagagcccgagccuagcuccagaacacuuccgucauccuagaaaaaaaaaacucccaugccugguagagucacucucaauucucuccuaaccacagacccuggcaaccacuuaucugcuuucuggcucuauggauuugccuaauguaaauauucauauaaauggaaucauguaauauguggccuuuugugacuggcuucuuucacugagcauaauguuuucaagguucauccauauuguaucaguccuucauuccuuguuguggcugaaaaagauuccauuguaugaauauaccacaugcuguuuauccauucaucagcucuugggcauuugggugguuuccauuucuuggcuauuguaaauaaugcugcuguguaccuuuguguacaagcuuuuguggaaauguacauuuuauaauuuucuuggguacauaccuaggagaauuauucaguuguaagggaacucuauguuuaacuuauuuuauuauuauuauuaauuauuauuauuauuauuauuauuauuauuauuauuauuauuuugagacagggucucacucugucacucaggcuagagugcaguggugcgaucuuggcuuacugcaaccucugccucccaggcuuagccuauucucccaccucagccuccugaguagcugggacuauaggcaugugccaccacacugugcuuuuuuuuuuuuuuuuuuggcauuuuuuguagagacaggguuucaccagguugaccagucuggucucaaacuccuaagcucaagcaauccaccugucucagccucccaaaguccugguauuacaggcaugagccaccgcaccuggcccuauguuuaauuuaacaaaucaacuuuugaucacauguauuacuuagcuaagccucucuacucagaaggggagaaguauaggagcaagugguugcuuuagcaaauguccuauccuguccuaucaauaugauggugucuccuucuugggguuucauaagucaguacccugaaggucauugacacuccauguguguauuuucuaugcagaacccccacggaggccacuuuuggucgccuucuccauacaauagauggggagugaccauaaggaaguaccccuuaaaguaacuaaagagcucaagcuugagcaguggaaccucuccagguacuucuaagagcaggacagacagggucagucuagagaagugaaugcuuugagaagauuacacaguccucuaacaauaacauccaugaugauuuuguagaauucucuaugccuagcauaaugcuaaaugagucacagccuuuuuccuagacuugcacucuccgguaugguagccacgggucacauguggcuaucaagcgcuugaaauaugguuagucugaauuaagguaugcuauacagguugaguaucccuaaucuaaaaauucaaaauauaaaaugcuccaaaauccaaaacuuuuugaggacuaugaugcuacaaguggcauuguugguggugacaaagccugcuguucucugcuauugcugcuguuuagcaagugauacagguauucuuuuuuuauuuuuuauuuuuuuugagacggagucucgcucugucgcccaggcuggagugcaguggugcgaucucggcucacugcaagcuccgccuuccggguucaggccauucuccugccucagccucccgaguagcugggacuacaggcgcccgccaccacgcccagcuaauuuuuuguauuuuuaguagggacgggguuucaccguggucucgaucuccugaccucgugauccgcccgccucggccucccaaagugcugggauuacaggcgugagccacaaugccuggccgugacacagguauucuaagggaugcugcugugcugauuaguaacucugaacacauuguuuuuuucacuauuuuaauaguauguuauauauacauauauacacauauauauacguguguguguguguauauauauauauauauauauauauauauauauauauguaacagagugauauacaaauauauauauauauauacacacacacacauauauauauguauaucacucuguuaccuaggccggagugcaguggcacgaucuaggcucacugcaaccuccgccuccugaguucaagcgauccuccuggguucaagcaguucuccugccucagccucuggaguagcuggaauuacaggcgugcaccaccaagcccggcuaauuuuuguauuuuuaguagagacgggguuucaucauguuggccaggcuggucucgaacuccuggccucaagugauucagccaccuggaccucucaaaaugcuggaauuauaggaaugaaccaacacgcucaugguguguuauauuuuuuacuguuaaguacuuaugucuaaauaaacgugagaaaaugauugcuuaucaguagcacauaaaugagcgucaggaaugauguugccaaacaagcacagauugucccaugggugguugagauagugacaccuuugguuucugaucauucgauugauaaaaacuuuguuucaugcacaaaauuauuaacaguauuauauaaaauuaccuucaggccauguguauaauauguauaugaaacacacaugauuuuugaauuuagacuugggucuuauucccgagauaucucauuuauguauaugcagauauuccaaaaucugaaauccgaaauacuuguggucccaagcauuucgaauaagagaugcucaaccuguacgugugaaauacacauuggacuucgaaaacuuagugcaaaaaacagaauguaaaauacucaugaacauuuuuuacauguugaaaugauauuuuggacaugaguuaaguaaaauauagcacuaaaauuaauuuugccuauuucuuuuuacuuuucuuaaugggcuacuagaaaauguuaaaucacacauguggcucacauuguggcuuccauuauguuucuauuggacagcacugguucuagacaaguccucacaguuaucuuaucagcuggaugguauuaucauccuucuauuaugggugaggaaauugaagcuuagagcgcuuaagucaauuaccuaugaucauacagcuguggcuuaagcgcaacucugucuccaauucugaauucuuacccauugcucuaggcugucuccccauaguccagaaauguaacccaagugauagaaaaaugguuaggaucauuagcuguggcaaaaggcuguuuucauaucuucauuguagagcacaggaaaaauggucuaugaaguucuguaaaguagaauuuagggugcaguuggaggaaauugccuaugagaaaguuucuuaaauacuaacuccuguuuguaaugguucggggcucacccacugaggaucgaagguagaaggaacuauuucagagcuugcuuucauuucuacgauucuaucacaauugacauuagauucacaggucagccucugcuguaacauucagauugagauggaguagacugagaugaaugagugcuucauuuucaucccuuuucccuguaaaguggaggguuuuaauuucaucccauuucauucgaauuugugaaaaccucaauaggacauucuucacagcaauccugcccucuucuaaguuucaguggagaggagagacaaaacugucaaggagagaaaccauucucugaaauauuaagccauucucuaaaauauuaaaccauucucuaaaauauauauuuuaacuugguaaaaucuucuuuuuccuaagggcaucaguguucuucgcucacaaguaacucucguguguauaucauuaaugcuaacgauuacuaguuguuaaaugcuaugacaauuuuauuugcauuuuacauauauuauacuuguauauaacauguaucacggguauaauuuacuuuuuaaacuucaaauaccgaagaggaugcccaguuuagaacaguagcuccuugggcuauuuuuccaaguugggaaggcagggggaggauuggaauaauugcaaauuaagcuuugccacagggccucguucccaaauguuuaaacccucucauauuauuaggggcuaaaaauguugcuaagagcuuuuaaacagaaaaauagacuuacuugcuuuguuuuuguuuuuguuuuuucuugagacagggucucacucugucacugaggcuggagugcaguggcaagaucuaagcucacugcaaccucugcuccuugggcucaagcaacccucccaacucagcuuccugaguagcugggacuacaggcacacaccaccaugccuagcuaauuuuuguaucuuuuuugguagagauguggucucacuauguuagccaggcuggucucaaaaccuugaucucaagcaaucugccugccuuggccucccaaaguacuaggauuacaggugugugcugccacacccggccacuuauuuguuuuuuauuucuucccccagacuacaacuuuauagcuuaccaagaaacauggcaacuggacuccuauaagauuaaugcaagccaaaaaucaagcccuaagaagcuaaaacguuucuagacauauaugugccauuuuuuuuguuguuuguuucuauuuuauuuuuuauucaggaucagauuuuuagugccccuucauuagguucacuuuggcuuaaauagcuacauggaaaauacauuccagcauuuguuuuuuguuuagucacucuuccauaaaauuccuuagcgguuucaaaugucauucagaugagaugacaaugaaucauagaaggaagacagagagagaaugguauugggaaagggauagggagcugggaaucagaugaccugaauucuaguucuguugcaagaacaaauuggcaacaaggcccuggagaauucaaguccacaaaccuuucuuggaaaccuacuauguucaaggcauugaaauaagugcuguaggagcaacaacgaugaacaagacacggauccucaaggagcuuaucaccuggcaggaaggaaaguauauucacaaaaugauaguauaaugugguacagaaugugugaguaguggaauagaacuuauggggcacagaagaaaaaaaacaucauuccagccagggagaguggggauggcuucaugaagaaagugauauuugggaucccggaaguguggguaggauuucuggguggggcuuugagggaaggguguuuucguuguuguuguuuucuuuugcuuuuuugagacagaguuucacucuuguugcccaggcuggaguguaauggcgcgaucucugcucacugcaaccucugccucccagguucaagcgauuuuccugccucagccuccugaguagcugggauuacaggcacgcgauaccaugccuggcuaauuuuuuguauuuuuaauagaaacagaauuucaccauguuggccaggcuggucucgaacuccugaccuugugaucugcccgccucggccuuccaaagugcuaggauuacaggcgugagccaccacgcccggcccaagggaagaguguuuuacacagaagguguagggaaguggagacgauguaagcaaaaauguacaguaauaaaguacagagcugguucaaggaacuuguuaggaaggcacaguuaauucugaauaaaacaaugggagauaaguuuugagcacuagauuaagaucaaauugugguagggcuugaauuccagucugaagaauuuagaccuuuugaguggugaagagcagggagacaaauaagauaacacgagugaucagcuuugcuaggaagauuguucuagcggcaccgggugguacgagggugagcagaaagguagaaggccgggagaugaguuagaaaacgguuauggggcuaggcacgguagcucaugccuguaaucccagcacuuugggaggccaaggcagucagaucgcuugagcccaggaauucgagacuagccggggcaacauggcgaaaccccaucucuacaaaaaauacaaauguuagcugagaguggcagugugcaccugugguuccggcugugcaggaggcugagaugggaggacugcuugaaccugggaggucgaggcugcaaugagcugugaucaugcccaugcacuccagccugggagacucuguuucaaaaaaaaaagaaaaugauuaugguaggcuuuuggcgguaggaauggacagagaaggcaaaugcaagagacauuccagagggaguauugacagagcuuggcgacaauugguuuugggauguaaaagauuacuaugguuuugagcauuggugagucagaggauggagaugcugagacuguaggagguuugccgggaaagaugcugaguuugauuucgagcacauuuagcccauuccgaacacacuggcuaacguaaucauauaaaacacaggccaauucccaaauccccucugcucaaaacccuucaaugccuucucaucuuacucagaguaaaagaaacauccuuacaauggcugauaaagccuucaauggccuggcugcccacauugccucugagcucaucuccuuccuuacccgcuucucgcugggcacugccacccuggccuucuugcuguuccccaaacauugcccgacaugggucugucuuagggccuuucuuaguguuuucucugccugaaacccucuuuccucgggcaguucuuacaccuuaaucccucacuucuuuuggcucuuauucaaauauguuuuguuuuguuuuugagacagaguuucgcucuuguugcccaggcuggagugcaguggcacgaucucggcucacugcaaccuccgucuccuggguucaagugacucuccugccucagccuccccaauagcugggauuacaggugcccaccaccaugcugggcuacuuuuuguauuuuuaguagagacaggaugggauuuuaccauguuggccaggcugaucucaaacucuugaccucaggugaucugccugccauggccucccaaaaugcugggauuacaggugugagccacugcguccggccuaaguaucaucuuuuuagaaaggccuuuccugaucauccuguacagaacagcaacacuucccccgccacauccccucucuccaguuuccucuuccccauuguacugaucagcaucugacauacuauuuguuuacuugcuuauaucacaaccuggaaacugaagcuguaaaaaaaaaaaauuaaugaaaugauccacuguuuucaaggguaugaugagguuugcuaccucaugaguacaccauuacaccauucuugggacugggcauuguuauaaucccuuugaaaagcaauuuggcaguaaguauaaagagucauaaaauguccaucuccugcaacguuuuauguuuugaaaauucugaaagucaauucuaagaagauaaucuaaaauguggaaaagaaggccagguaugguggcuuaugccuguaaucccagcacuuugggaggcugaggcaggaggauugccugagccuaggaguucaagaccagccuagggcaacauggugagacucugucucuauaaaauauaaaaaauuaaccagguaugauggcacauaucuguggucgcagcuacucaggaggcugaggugagaggaucaccugagccugggagguugaggcugcagugagcuguuaugggaccacugcacuccagccugggcaacagagcaagacucugucucaaaaaaaaaaaaaaauaauguggaaaagaaaacacacagaaaaauguauacuaaugugauauuuaugauaucaagaaauuggaaagauucuaaacaucuaacaauauacagagauaguuaaauuaaguaaauuacuguucauuuacuuaaugauauauuauucacuuguuaaaaggauaguuaugaaaggcugguuagcaacaaggaaaaugcuaugagacaauguuauacuuaaaauaacaggauccacaacuguauacagugugauuucacguaucuuuaaauauacaccugaaaaaggacuaggaggaaauuaacccaaaugcugauauuaaaugaauuaggcuaauggaauuauuggugacuuauuuuuccuaaaucuuuucaguuuucuguauuuagguuauauccuuucuguaaugugcuauuuaauuuuuuauaauaaucauuuuuuaaaauacucaaaagaaacugcuguuacaacuaacucaccaccaucuagauggcauuguuggguaucagugguaagugugagucuccaggcuguggcuucuacuuuuaguucugaggauccugacaucaauggcuggcccuacagcucauuagccucccaugccucauuccuccgcuuucucacuccugacuccuuccucuuugccacucuuccuguauaauuuuaggcugugucugccugauuaugaaggacacaauuaugaaacaauaaaggcuuuaaaaaaaagccacacaacuugcccccaugcaccuugacaaucuuuaugcauggauugaggcuaagccaccauauuaaugucccccucuauuuuucucauccuagcuaccccuguccccacugguagacauuaaggauucccacuuugcuguucucuguagcgcuuaccaccaccugacauauuauguauuuacuuauuuauuauaauaucauggcugagaaacugaagugacuuaaaaaggaaaagaauuaauucaaugucuaccuacuaagugccaguuaagccuuuauguauauuuucuuuauguauauuuucuuuauguauauuaccucauuuuacccuugcaagccagcaaaauaaguauuacguuuuagugauaagaaaacugaggcuuagaaagguuaaauaauuuguccaaguucacuuauguaggaaguuaccaaauugaaauuuaaaucguuguuuucuuuuuuuuuuuuuuuugagauagcaucuagcucuuccaccuaggcuggagggcaguggugcaaucuuggcucaccgcaaccuccaccuccuggguucaagcaauucgugugccuuaaccuccccaguagcugggauuacaggcacccaccaccacgccuggcuaauauuuguauuuuuaguaagacggguuucacccuauuggccaggcuggucuccaacucaugaccucagugaucugcccuccuuggccucccaaagugcugggauuacaggugugagccaccucgcccggccagccaccgugucuggcugaaacccucauuuucucaucuaaaguccuauguccuuagccaauacacuaacaaacacacaucaauuauuaagauagccuaaguuaacuuauuauauaggcauugccuaagugaacaauugaauaacagaauaauucaaucugaaacucguaaucaauugaugccccaaauaucguuguaucugaguuaaccagcucauugcuucagauuuuuucugcaaugucuacagugucucgauaacuauuugagaccacaaaauuaacaguuugacuguuaauuuuaacuacuuugauuaucugcaguauucuaaguauuuauuuaguaacuaaaacuaauuuuaucugcuuugauuaauggccucuuuugaaggaucuggaagcucuuuuuugagacaauagaaaauuuuuugauaaagcaaaauucuuaauuaaguuagauccuuucaacugguuaguuagacuuacgaauugagauuauuaauagcagacauguaagaugucaaaaggaauguauuaucuaguuaggacuaauaggauuuuagagaaaauuuuucacaagaagagauuuuuccauuuaauaacucauuuauuuucaagcaauagucuguugaauaaagauucuaagcaaauucacuguaauggggaugaaggaauuaaauagaauuucccaagaaauauuguucauaauguucaccauuauuacagcucaacgguguucuuguaugccugcuuuggcuaaagucucacauagaaaacccuuucaccuaggcauggugguugacaccuguaauccuaacuacuugggagacugaggugggaggaucgcuugagcccaggaguuugaggcuauagugagcuacgaucaugccacugcacuguuggauaacacagcagacccuaucuuuaugaaagaaagagagagggagagagagagcgagccauuguagcugcugacauagacuugaggagucauaacaugaucacccucaucauagcuaacaauuuugagaauuuacugugagccagccuucacugcauacugcacuaaauuaucucauuuuaaugcucaaaauucuauaaaguaggcacaaauguuauacucauuuuuagauaaagaaacugaggcauagaaagauuaaguaacuuguucaagggacagcauuuaacauaaaacacggauauguuauauuggcuguuuugccuucucugugaugcugagaaaauaacauuuuuugaaggaauuucaaguucgacuuuacagcuuuaauuuaaaaggaaaaaugaaaggccuuuugaauugcuguggcuguuauaccagugacuaauuccauuggaaagcugguucagugagagcugaaauuuuaaaagucugaaacaucugagagaguggguuccccuuggcuaguuggugcuucccucacaaccuuuucccacaucagccugugcuguaaaccucccuuucacucugugaugauuucaucucugaggguuuguaacucauggagcuguccuuggucugacaggucagagaagaaaaguuuuugccuggggucucuggcuucucacaaaguugcugcacuucucaacugauuuauauuaauagaaauccacaaacccaccauguacaacagauugagagaauucuuaggagagugcaugaaaacgcugaaguacuucaucauaguacauuuuaauuuuucccugcauuggagcagagcuuucccaucuuagaucaggaaaugggaaaccuaaaguucacuuacucaauaaaaucaggcuggagacccauuuugggcaguucuaaaugcugcaaaagaucaagauaacauuccuccccucaaagauuuuacaugucagugauaagacacacauaaaaaaguuaaacaacccgacaucauaaagagaugaaucagaagccaauaggguuccaaggauaccaaguguuugaaauccaaggcaggguuacagggaggaggucauuggaugcugaaauggugagggagguuucuggggagagagaggaaacuuaauauaggucuugaagaggagaaagcuagccacaggacagaguguauacuguaaccccacuuaccuaaaaaugaagcaaaacaaaaacuguauagguuuauuaaaugcagugaaaaagagucggaaggauaacuagcaaauuggaagaagggcaauacaguuggcaggugggagaggggaagggcuagaauuaauagggacuuucaguuuuuacuguauguauacuucuuuauuauuguuuaaauauuuuucuuucuuuuuuuuuugggaucguguuucgcuuuuguagccaaggcuggagugcaauggugcguucucagcucacugcaaccucugccucauggguucaagcgauuuccugccucagccucccaaguagcugggauuacaggcauccaccaccauggccagcuaacuuuuuguauuuuugguggagacaggguuucaccauguuggccaggcugaucucgaacuccugaccucaggugauccacccaccucggccucccaaagugcugggauuacaggcaugagccaccucgccuagccuguuugaauauuuuucuaaugaggauauacucauacauuguuugguauaauuaagaaauacaacauugacaaagaacagauagaacuuggguuuguagagcaaaagaaagaggauauuuuaguugagaagaacagcuuaaguacaugccugaaguuggaaauguccaggguguauuuugggcaacaaugaggagaccagugggaccagcacagaagggacauaguagcagguagauuggggccagguggagaagagcuguuaaugaagaccuagugugagccuuucaccuuccaccaaagcaaugaagagccuucgaagaguugaucuggaguccauuaaucuguccacacaagaauuuauuuauuuauuuauuuuuauuuuauuuuauauauacuuuuuugagauggagucucgcucugucgcccaggcuggagggcagugacacgaacucggcucacugcaagcucugacuccgggguucaggccagucuccuaucucagccucccaaguaacugggacuacaggcgccugccacaacaccaggcuaauuuuuguauuuuuuuuuuuucuuuuugagauggagucucgcucugucacccaggcucgagugcaguggcgugaucucggcucacuggaagcuccaccuucuggguucacgccauucuccugccucagccucccaaguagcugggacuacaggcacccgccaccacgcccggcuaauuuuuuguauuuuuaguagagacaggguuucaccauguuagccaggauggucucaaucuccugaccucgugauccaccugccucggccucccaaagugcuaggauuacaggcgugagccaccgugccggccaagaauuaauuuauugaugagcauaccugaaaaccuagcaaaguuagauaauagaaauugaaaucuaccuuucuuguacaccaugaaaagccacggaacugucuccuauaguaacugcagcaagaaagguucugauguauacaaaccugauguuggacuuuucaagaaacacugaaaauagaaaugcugucagaugcaacuggggaacaaccacuuauacuugauccauaguauuaauuccacuguaaaucucuguguaaugcuugauagcuaugaugaaugacuuaaauguaguagagagauuuugauccccagcauaugagaaaugacugagucaaauuuguagaaguugauuaaaaauuacuugauuuaaacaaaugaaaaucagguggauucuguaacaugauauuugcauuagugaauauguguuuuccuugaaugaauugacaaaaaucaauauuuucuuuaaacuugcauuuauaacacuauucaaauacuuauguauacaucauauuuuguauauacaaacacacacacacacacacacacacacauucauacaacagacauaauaaagcaaaaaucuguagcuaucugggagugacgaaguaccugacguacaagcccaucuugaaggaaauauuaaaucuaauaagggaaaaacacuacagauaguugaaccuugagucagucaugcauucugacucaugugaaaugauuggauucugggugagaugaauuuuuuuauugacaacaaguggaagagggacauaucggaguccuagaaugauaaugcaaauuagcuuuauaaaaacauagucuuggccgggcgugguggcucacgcccauaauccuagcacuuugggaggccaagguggguagaucaccugaggucaggaguuugagacgagcuuggccaacuuagugaaaccccauuucuacugaaaauacaaaaauuagccuggcguggucaugcaugccugcaauuccagcuacucaggaggcugaggcaggagaauugcuugaacccaggagguggagguugcagugaguugagaucgugccauugcauuccaaccugggucauagagcaagauuccaucucaaacaaacaaaaacacacacacagagaaacauaguuuucagcugacucggugcugcuccacgaggagcagcuuaaaaaaacaaaaacagccuucuccuguaggagcugaauuaaaaaaacaaaucaaaacaaaacaacaaaacaacauagucuucauuuacuacagauuuucuuguaaccagaaguacugacaaauugaauugaguuuucaguuuucacuuugcuucuccagaguuuaaagaccuuuuucuuuuucuuuuuuuuuuuuuuuugagacgggagucucggucugucacccaggcuggacugcaguggcacgauucggcucacugcaagcucugccucccggguucacgccauucucccgccucagccucccgaguagcugggacuacaggugcccgccaccgcacccggcuaauuuuuuguauuuuuaguagagacgggguuucacuguguuaaccaagauggucucgaucuccugaccucgugaucugaccgccucggccucccaaagugcugggauuacaggcgugagccaccgcgccccacccuuuaaagacuuuugaugcucauuuaucccucacuccaccguuuccuuuucauuccacaauaugugucuuuuuucagagacacagauggcacucuuaaucggaaaaacugaacuuucuugccuggugaugggaaaacaauagcggggacaagaaagguuuuaaaagccuucgaaaguuccuuggaaagggagauuccugauuucauauguugcauuuuccucagaacccguuuucucuucuuaauccuucuuuauccuacaaaauuacuuugugguaucucuucccgacaugaggugagggcagcacaaggcaucugaccuccacauguugggagaaggcaggaaugcaagaugauccugugccugacgugauuaaacagacucacacacauuuuacaauaaccaauuuuggaauaaaaaaugauccuuuaagaaaaaucuccugauuguuuuaauauaguucucaguaccaaucuugaugagaauugauaauucaaaccaguaaauauuuacugcuaccugccaaguugaauuaaaaaaauucauuugguucuaacaauauuguacucuugaguagaguuauagaacaagagcaaguacagacuaaguuuccaguacaauucagacagggcaagucuguucucuccuccccacuugucucccucccugauaacugguagaugauagauagauagauagauagauagauagauagauagauagauagauagauagauaggguggguauauagauaggcagauggauggauggauggauggauggauggauggauggauggauggauggggagacagagagauaggguggguggauggauggauggguggauagauggauaggguggauggauggguggauggauagauagauagauuagauuagauagauagacagauagauagauagauagauagaauggauggauagagagagagagauagaauggauggauggauagauagauagauagauagaguagguggaagaaacuucuuccugauuuuguuguucucccacauaugaaaagauggagcuucugugacugacaauagcuuaagcaaagacagggaaauaauauuuaugagugcagaaguuagucaggucauucuaaguagaaagaugacagccaauuuuguaaucccacaacauuuuuuaaaagagaggaaggauuagguauuggugaagaauugauacccuaaaauaaugcuaagaaaaaauaggaacaucuagagaguuaggaaagauuuuggacacccaaauaacuacccuccauuucuuuauuuguacaucaacauguuugagauuaaacauacaaaaauacaaauaggccgggcccaguggcucaugccuguaaucccagcacuuugggaggccaaggcaagcggaucacaaggucaggaguuugagagcagccuggccaauauggugaaaccccgucucuacuaaaaauacaaaauuuagcugggugugguggcacacgccuguagucccagcuacuugggaggcugaggcaggagaauugcuugaacccgggagguggagguugcggugagccaagauugcaccauugcacuccagccugggugacagagugagacuccacucaaaaaaaaaccaaaaaacaaauauuacucugaugaugcuauuacauaucuccaaaagcaaacgaacaaauaccccauuuacucccaguugacauugauuauuuuaucccugguuugugaccuaaaaugaauugaggaacuuacuauauucaguucauuucugccuucccucuaaguucagggauaaacuucaaaguuuauuauuuuuauuaaaguuuauuuuaucaaaacauugaauauuuguaauuuguaacauauccuauauauuuuuaauuuauacgaaauaauaauuuccuaaaauaugcaauuaaugguauucuuaacagauucacauauuuguauauauugaaguacuaauuuauggaaaucuaucuuuccuuuauguauuuuuaaguuuuucaugugcuuuaauauuuugauuuugugauacuaaaaauauuuuauuuuguggguuuuuaaaaagauuuauauuauugcuuuccuuuuuuuaaccaacagcuaaauuuggaaguucuaucuuacgucucaaaugauccuuguugguacaaaaaguguaucuuuuggggagcuauaaagauuucuugucuuuuaagccucauuuacaaaguuuuugucaauuguuuuauacugacuuucucauuagcuugccagcaauaagcaaaaauaaagcuaggacugugucaaaaauauucacuggcccacauucauccuucuucagcagguuuacuccauaguguuccccauucagcuacugugcuggccaauggaaacagcgagucguugucugaaaugaagaauaauuggaaacauggugccuguuucuuuuccugcaaauaacaauucauccauuuaacauucuuuuggugcucuugaauucuguaguagacagccuuguguucacuguucaguugaggcccauucgagaaaagcuaaccuucuagccugcuguugacccuccaaugggaaacagugacagccaucaauggcuucuacauagagcuagugacauguggcacuagcagcuucauauagguaaaugggccucaggcuggaaaaugcuaggcugggagggaugguaauaaugauaaaagauuaaaauucuggcuaugaugaucuccacuuuccaaagaaacaaagcccagaaagguuaaguaacuugcacaaggucauuuugccagcaagcuguagaacagacuguuuccagcaucuuucuuuuguacccuacacaaucuuuuauggccacauaugugauugauuuuguaaauguuccauacacauauaaaaagauugggcagggcgcaguggcucaugccuguaaucccagcacuuugggaggucaaggaggguggaucacgaggucaggaguucgagaccagccaggccaauagugaaaccccgucucuacugaaaauacaaaaaaauuagccagacgugguggcgcgugccuguagucccagguacucaggaggcugaggcagaagaaucgcuugaaccugggauugcggagguugcagugagccaagauugugccacuggacuccagccugggugacagagcgagacuccaucucaaaaaaaaaaaaaaaaagauugcauauucccuuuuugcaagguauauauaugugguuuuuaugcuauuuacuaaucacauacacucuuauauauguguauauaauaagccucugaugauaucauuauaguugucuauauucuugcuuguuuuugacuucauguuccaucaaauucugaaagggauguauuaaaaucuaccacuaugguuauaauuucaucaaaugcuccuugucuuuugauuuuuauuuugcacuguuuuuaagugcauaauagcugauaacuuguauaucuuugucacauuucuauucauaucacaggcaauugggcuggcugcauaaaugcacacaucauaguggcuuaaauacaugaagcuguauuugucucauauaaaagauguuuggagguaggaaguccaggacugguauaguagcucuaugguaaucuggaaugcaagcugcuucugucuuccuacucugucaccuuuagugugugguacccauauuucaagucaugguugcaagauggcuccugcagcucuagccaucacauacauauuccagacaggaaggaggaaaaagaguaaaaaugaguaauccaggugaguuagauuucagcaggccccauccacuaacuucugcuuacaacuuacuguuuuuugguuuuugagacggaguuucgcuuuugucacccaggcugaagugcaauggcguuaucucggcucauugcagccucugccuucuggguucaagcgauucuccugccucagccucuugaguagcugcgauuacaggcgccugccacaugcccggcuuuuuuuuuuuuuuuuuuuuuuuuuuuuuguauuuuuaguagagacgggguuuugccacguuggccaggcuggucuugaacuccugaccucaggugauccaccugccucggccucccaaagugcugggauuacaggcaugagccaccuacaacuuauugucuaucccuaaguacaaaaggagauggaaaaauuaacuuaaaaaaaaaucuggacacacugcugcuccaaauuaaauugaaguuuuguuagcaaggaugaagaggaauggacauuguguaagcaucuagcaaucuuugccacagucuguucaaucguuccagacucuuguuccuauuuaaugcuucuggccuugaauuugcucauauuggcacuccugcuuuuguuuauuuuguuuugcuuuuuuccuuuuuuguuguuauuuuuggcaaucagcuuucucagguuaaacacuccugcuuuuggaguucccugacauauaucugcccagucauuuauuugcaaacuuucauagucacuuucuuagaggugaauuccuuagacauagcuuaauuuuguuuuggcccaauauaaaaguuugccuuuugacacagagauucaacucauccacauuuuuagugguaacugauauuuuuuuauucuuuccauuuuauuuuuacuguguauuauacuucauuauuguuuccuuuccucccuuuccuuagacuuacuggcuugaucauuuuaagaagguauuuucuucuguuguuaaguaggaaguuuucuucugaagcacuugcuucucuuauauaaauaaauaccuuucuugacugaauaagcauauuccuguaucucagagauucauugugaauauguugaagaagaaauacaauuuauuucuuuacuagugaaauaauaaauaaggucaugggcaccauguaauaauuaaggaagauuauauuccucacuuccuucaacaucacacauagacugcaacaaauaucucacuacucccuuaagcagggcuggaaaugagcccugucuugauggaggugcuguguggucagcacuuccuagauuccuuuaagggucuaccuauugaaggaagaaggucagcuguuauccuaaaauucuaaaguccacauggagaagaauuaugaugaguauucauccauacacuucucuaacucuacugaaugcaaaauaaguuaucaagagugacaaggcaaauaauuaugacuaauacuguaauacgcuuuguggcuugcuaucuccauugcauuuguuuuuuaaaagagacauuauuauuauuauuauuauuuuguuguuguuguuuugagauagggucuugcucugucaccaggcuggagugcaguggugcgaucucggcucacugcaaccuccaccuccuggguucaagcaauucuccugccucagccucccgaguagcugggacuacaggugcaugcugccaugcccagcuaauuuuuuguauuuuuaguagagaagggguuucaccguguuagccaggguggucuugaucuccuguccuugugauccgccugccucggccucccaaaaugcuggcauuacaggcaugagccacugcaccuggccgauucuguuauuucuaacauuuauuuuuuauuuuuuagagacaaggucucgcucugucauccaggcuggagugcaguggcacaaccauagcucacagcaguuugaacuccuggucucaaguaauccuccugccucaaccucuugaaguguuaggauuacaggcaugagccaccaugcccagccaaaagaauuuuuauaaccuuuuuuccauggaaggcuugaguucuacaaaguuugucauagcucugugaagaacuuacauaugaaauguagcucuagauuacuuggugaaauuauuaauccuuuucugauacucuuacauguacauaaauauauugcuucugaaagaaaccuuuuuucuugugucuggcuccaaauuauaccuuccccuucacgcuacagcaggacucguucccaagagcaaucacagauccuaaaaugaagcaaauggugcaaauguuaccauuuauguagaaauguugcuguuuuuaccaugaggaacaauauaaaagaagaaaccaauguuuuaugaaagcuguuuaaggccgggcgcaguggcucacgccuguaaucccagcacuuugggaggccgaggcgggcggaucaccugaggucaggaguucgagaccagcauggccaacauggugaaacucugucucuacuaaaaauacaaaaauuagccgggugugguggcaggugccuguaaucccagcuacucaggagaccgaggcaggagaaucacuugaaccugagagguggagguugcagugagccaagaucccaccacugcacuccagccugggcgacagagugagacuuggucucaaaaaaaaaaaaaaagaaagaaaaagaaagcuguauaacuuuuacucaaugucauucuaauuuauuucuuucuuaaaauuauuauuuuagaucccuuuugggaaugguuugguuacaaacugguaaacauuuucauaaaucuuagaauaauuccauacagaaaauuauuuguacucuacaaaaauauuuauuaaaauauacaauacauaaaugacuuucuauguacaagaaacucuccaucuugaaacauuuguguuauaauaucugucccucgugcucucucucaauaucaagaguacagcaacacccuuacaugucugccacucaccauauauuuuggggguaaauugacaaauaauuaauucugcaguuggacguuuuccccuucccaucaccauuauuuuccugcaacuuuucaggcaaagggagcagagcauggugucacaggaagauaaugauaauaauuaauguuaaauccacuacuuccuccuccucuuagguauuuucccuccaguauugauuaugaaagaggcuuagccucacaucagcccuagaagaagugggagaaauuugagaauaagaaagaaaagcaucugaugaaaauaaaauuauuauagaaaacuauauaugcauaaacauguuaucagguuuaaacauuaaaauguauugguauuuaguaugaguuuaauguuacuagcuacuaacaucuauuaaaaauuaggcuucaggccaggcgcagugacucacaccuauaaucucagcauuuugggaggccaaggcaggaggaucaagugaagccagguguucgagaccagcuugggcaacacagggagacuucaucccuaccaaaaagaaaaaaaauuaacuggacuugguggcgcacacauuuagucccaauaacucgagaggcugaggcaggaguuugagaccagccuggccaacauggugaaaccucaucccuauuuuuuuuuuuuuuuuugagauggagucucguucugucacccaggcuggaguccaguggcacgaucucagcucacugcacccuccaccuccuggguucaagcaauuauccugucucagccuccugaguagcugggacuauaggcgcaagccaccacgcccagcuaauuuuuguauuuuuaguagagacgagauuucaccauauuggucaggcuggucucggacuacugaccucaagugauccaccugccuuggccucccaaagugcuaagauuacaggcgugagccaccacacccggcccccaucccuauuaaaaauacaaaaauuaacugggugugguggugcgugccuguaauuccaguuacccgggaagcugaagaaggagaauugcuggaacccgggacggggaggcugcagugagccgagaucgcaccacugcacuccagccugggugacagagugaaacuccaucuccaaaaaaaaacccaucauaaauauguucaucaauagaguuaauagaguucaaaacuggucuggauucaauauguugacaaaaugcuucaaaccuggauaccaguccugcaguugacacuguaugauugaauuugggaaaaacagguucccauagcuuucaggaauaggguuugaaaauacuggaauugaaaagcuucaguaagagaagacaaugcuuaccacagccaagcugucacucucuaauuauuuuuacuuucacguuauuugggcccaaagaacuagaugaggaaucaggaguuuacauaaacaaaucccuggaauauacaauuuagcuuauccuuuagcaucucuauuuuuccuccaguugagugagaagaaacccuaagaccaaaccuuauaucuuccagaagcauuuuaaggaauaaccauguuugaaagauuucucuaaugagucauauagaauucuguuacuauagagagauugucuucuuugcuaagaacaaauagagaauaaagacuuacaaauaaaugaguuguuuuaagagucuguuuuauagugucaccuuuuugugaaauuccccauuauacugccacauuuuaauguucuuuuucucuggccugggcuuagagcaaugaucugccacucucauguaugaacuaugcacuagaguacagaaauauacauaaucuuugccuaggguauaauuuuagugggcugacgcagcagcacaagaaaggcucugaaaugccaguggguuacacaugcauugaucuugacaaauucuaugugaucaacgugaccauggcauaccuugugacuuuuuugguugguuugcuuaaaugucaaucaaauuuuaagauaauuaugagaugaaaugcacuaggggaccuaccacacagcaucagguggauguggagugguuuugcuacucauauaaagugaaauccugcaaaauaacacccucaaaggagcugaauguaaaggagaaaggggaagacaauaucuuaucauuaaaaaucaaucagauauuuacuaagugccucuucugaugacuucuuacauuucaguggcuagcagaucuugguucacaaaauacuuucacagacauuaucuuauuugauccucccaacaaccgguaagguaagagagguaaucugaaaaugaggaaauggcaacucugagacuuaagugcuuucugaggaccuauacucagcuugacggggguggggagcauuggaacugcccaggucuccaaauacucuguccuguaaucauucccucuugaucacccacuauuguacuccuucauucucugucugguccuguggaggaguccaaagaaauuggaaggcguaaaucuugcccucagggagauucugcucuagaugagagaaugcaaguuuucguaauaaaaacaacagagaauuauuaaguguuaaaccguaugaaacaggcuacaaauauaguaacagauuauuuucacuggaaaauaagaugcuauaaauuguacccaauggccugaaaaauguaugugcaggugccugagaauaguggucaacucaauguuucugaaguuuuccagccaggcaaucaauguuuuccuagagaagucucaugguuaauucuugacuaggagaaaagccaacaagcacuaucuugcccagcucuuuggugacacaugguugcuucuaagagccaauucuugaaucuuugaauucuuuuuagccucuguugugccucagacugagaacaggaagcuugugggaaccaguccuggcccugguaccuuguugcauccucuaaacgaucaguggaggccaccgaggaaauugccuguucaccuccuccuaguuaucuaguuugcaaacggaguaaagaagaagaguuacuuuuuuuuuuuaagcugccuugaggugggagaauggacacauuuguucucuacucagagagaccauagacuucaagggucugcagggacucugugaucacuuuucuuucuuuuuuuaguuuuuuuagagacagggucucacuaugugacuauucacaggcaugaucacaggcaugacuacagugucaaacuccugggcucaagcaauccucccaacuccgccucccuaguagcugugacuauaggugugcaccacugugccuggcuuuauuuucuaaugucuuaaugcucaaaccuaaaauucuccaaauccauauuuguuucagaugcaaaauucuauuccaaauaucuguucuuuguuuuuuucagcagagcaagccuguccuuagaaacagcugcaggccagucacugucucucccugucuuuaucuucccugcugaguggcauguugcuugcaaggccccauggggacuuccaaagccuuccauaaaugacuggcaguaauacuuuuuuuuuuugagauggaguuucguucuuguugcccaggcuggagugcaauggcguggucucgguuuacugcaaccuccgccucccggguucaagcaauucaccugacucagccucccaaguagcugggauuacaggugcccgccacuacauccagcuaaucuuuuuguaauuuuaguagagacaggguuucaccacauuggccaggcuagucucgaacuccugaccucaggugaucugcccgccuuggccuccaaagugcugggaucacaggcaugagccaccaugcccggccagcaauacuuuuuuaaagaugcacacacccagccagguucaccaguauuauggauguuucuguguagucuucuccaaaaugcuaauuugcugaaguguccaugggaauaggccaacacggauggaucuacuguauaacuugccugccaucaggaaagagucaacacggcagacacaugcuggcagaaacccugcuggaguugccccugagcauugaugcauaccacccgagaggaggagaggguggugggagaaaucagaucagaguucagaaugcaccguaaugcucuguaaauguaagacugcaccuugcaggaacugucaaugccacuaccaauaucacucacuuacaucaagcacuugagagcagcugcgaacacaauucucugacuccuaaccuuaagcacgugacugguaccacuggacaaccuauguucucaaagaugcaucuuuuaaacuacuuucccuaggggcccggcacgguggcucacaccuguaaucccagcacuuuaggaggccaaggugggcagaucaccugaggucagaaguucgagaccagccugaccaacauggugaaaccucgucucuacuaaaaauacaaaaaaaaaaaaaauuagccagacacgguggcacaugccuguaaucccagcuacucgggaggcugaggcuggagaaucgcuugaaccugggaagcagugagccgagaucgcaccacugcacuccagccugggcgacagagcaagauuccaucucaaaaaaaaauaaaaaauaaaaaaauuacuuucccaggaguagaaauggauuuaugcugagucacucaagcuuucauuucauccagggguugugaacauagauucuggaaccagcucugucacauacuagccguaugaccuugggaaaauuaccuaaaaauucuccaugccuucaauucccgugugugaaauggugauaauuauaccagcuaccccauaaaguuguuuugaggcuuagagauguaaagagcuuagaacauggccuagcacguauuuuguaccauguaagugguauuuucauuuguucuucuaauauuaauuuaaaacaucugugggccgggggugguggugcaggccuguaaucccagcacuuugggaggcugaggugggcagaucaugaggucaagagauugagaccauccuggccaacauggugaaaccccgucuucacuaaaaaaaacaaaaauuagcugggcauaguggcacgcgccuguaaucccagcuaucaggagacugagacaggagaauuccuugcacccggaagguggagguugcaaugagccgaaaucaugucauugcacuccagccugggugacagaauaagacuccgucucaaaaacaaacaaacaaacagccucuguucugaccagguauggguggcucacgccaguaaucccagcacuuugggaggccgaagugggaagauugcuugaggccaggaguucaagaccagccugggcaacauagcaagauacugucucuauacaaaauaauuuuaaaaaugagcugggcaugguagcacacgccuguagccccagcugcucaggaggccaacgugggaggauugcuugagaccaggagaucacggcugcagagaaccaugaucgugccacugcccucugggcugggagauaguuagauccugugucaaaaaaaaaaauuaaaacaaaaccucugcucuggacgcugcuagguguugagagguaaaaacaaauaacaugcaguagguucccucagugggcuuacggucuguuuuauuacuuuacugucacuguuuuauuuacuuugccuagcacgccaguugcaaaguacucaauaaauguuucugaacguaugauugucuuguggaaacaggcaagcauaccaauaacuucaaugaaaugacaggauguaacugugccuggcccauaguaagugucugguaccauauaagcauuagcuaucuuaauuaugaguuuaguagaauaaaugcugagauugagugugcgggcugaagguugagggugaggagguagaagugcacucagggaagucuuccaagaggcaguaucauugagcuuaguuuugaucagcguguaggcguuagccaguaagagaagagggcuaaguguguuccaggcagaaggaacauugugugcagaguuagagaggcgugaaauagcacaauacauucagggaacuccgaguaggcaagaaggacuggagcgccauccuuauugugacauccagcaugcauuuguuaaaugaguguuugagauuagaagcugugggaugaaacaaaacaaaugagacauugcuuguguuauucuggccuucagcauugaacuaaauaagcagucauggacgaaguggccagaggauuuguucagugucauacuugcucugguacaaaugcuauauacuuuccuaccgcacagucagccucuucuuguccucugcuagaggaaguaaauucacuucauuugucuuuuuuuuuuuuuccaaaacaacugagauaaauuacaauaaaguugaggagacuguaguguaggugaagauguuuuugcauaguaacguauugcucuagagcagaggucagcaaacuauggccugagggccaaaucugauccaccgccuguuucuguaauuaaguuuuacuggaauacagccaugcucauuuguauacagguugucuauggcugcuuuagugcuauaacagcagaguuagguaguuaugacagagacuauacagccugcaaagcuuaaaauauuuacuggcuggcccuuuacagaaaguguuugccaauccuaggccaggugcggugacucaugccuguaaccucagcacuuugggacgcugagauggaaggaucacuugaguccaggauuucgagaccagaguccaggaguuugaggccacucugacugacauggcgaaaccccgucucuacuaaagguacacacaaaaaaacuagccaggcaugguggcgcaugccuguagucccagcuacuugggaggcugaggcaggaaaauugcuugaacccaggagguggagguugcagugagcugagauugugccacuguaccccagccugggugacagagugagacucugucucaaaaaaaagaaaaagaaagugaguguuugccaguccucacucuagauucuucucuucuaaucugauaaauaacaaccaccuaaauauuuaaaacaagguauuggguugguucagagucaaugugguaaacaauagguuaucgaauuuuaaaaauucaccauuaaggagagagaagauugcacauacguuacccauaaagugugugauaaacaugaauaaauaaauaaacauaguuucuacgauuggcuuuugaauuuggcucugagcuuccuagccauggggggcguuggggggaagaagauaauugaucaccuguauuaguuaccuguuacuucauaacaaaccaucuuaaaauugcauggcauauaacagcuaccauuuacuauuucucgagucugugaauuggcugagagguucugcugaucugggcugggcccagcugaccacagugggcuugcucacacauuugugaucagcugguauguucgcuuggagcuggcuggucuaaaauggcuucagcuggaguggcucaucuugacuccacaggaugucucauccuccagccggcuagccuggacuuguucgcauagcccuggcagguuucagaggagagccgaagcacacacuugaggcuuaggcuuggaacuggaacaccauuauuucaauuacauucuaguggccaaagccagccaaaaggcaggcccagacucaaggaauguagaaacagacuccagcucuugaugggaggagcugcaaagucacauugcaaggggcagggaaacaggagggacagaauugaggccauguuugaaaucacaaacaaucaaucaucaucuaaaacagcguguauuccaaccacaaaauuuuaaaagucaucucuguggucuaaagcggaaagaacgagucaucauacaucagucuauucagccccacccacagauaugaaucaucagugucuucagcuaagaggaccacuaucuucuagcuaaugacaaauacagaggagggguggaaagaagucuguuggaaauguguacauaucacaugagacccagacccauauucaaauaccacuugaugaauuucaccagggaaucagacucaguuuuaauggguuaaagggauacggaaaaucauugucacagauguaagcaauaacucaacuaaacaucagcuuuugaggcucaacccuaaacagaccuacaauauucuggcugauucccauuugccuccacuuuuaucauuggguggugguaaaauuggucacuguauucaaagaucauaucacuaccuauggauauggaugugauugaaaugacagacaggggagaauuuuuuuuaacuuacuagccauguaaugauuuuuuaaaauuuauugcuagaaaaucuucacuauuaccaaacuugccucaauaaaugauguuacguauaaauagcaacagcgaugucagaagaccuccuuagcauuucuuuuccugguaugauauggcugucuguaagaagagaguaaacauagauagcucuugcuucuuacgguauuucagaaucccccuagaaguuuuuuauauuaaaaaacaaacaaaaaaaaaaacacaaaacucccaaaccacccagacaaacccacccagccuagguaugagaauguucuuucaggccuagagccagucaggguccuuagcuuuguuugcaagaugccagugccuuuauacucagacuucguggagcugccaccauacuucuguaguaauagcaguagugaguggggagguacaugacagaauuuagagaacuauuagacgcccguugacucagacaucaggaccaccugugaauggaaauaucuuucaacuuagauauaauaaaaaggaacggagcuguugauguuauugaggagguggaaacaaaaccuucaggaugcuugaagauaacugguuuauaggagggcugggggcaauagggcugucuuaggaagaacaaaugaugcuuccaaaauuugagugcagaaaaucagaaguuaaccuugggugggucacaagguuaaauguaaugaaggcuaagugugacaagguuaaaugacauaacauauauaaaauaccugguggguuacuuagaagaguacaccucaaaaauguugguucccuccaucucucuggaucccccacccccuuaaggauuucuuaaaaaacgaaaaaccugccagccagcugccacuggaaagaugucaaguaggauaagcugcugauaggugguaacaacaaaauccacauccagguggauggagcagggggaugucaccucuccugccccuccccuaauuacaaguuggaggcagcauaaagacauuccuuccuuccugcagaggaaguauguguuuucucucagaccuaccuuggcauuccuugaugucuuagagaagcagaugaccccggcugagcaagacagucagcagaacagcagcccucgaugcugcaauuggaaauuuccauucuuugcuugcagcucugaaaaaaaaaaaaaaaucuaaagagcccaguagcugggaaauuuccaugauggaaaauuuuaacauauucuuuagcucuaaacuaugcagguuuauagagacuauuuuuuuuucuuuugguaauuuucuucuuuaacaauaauuuaugaucauuguaacacuacagcugugggaauaaggagaacaaaaugaguuggaggggaauggguaugguucaggcuagugggaggcugugcuaucuacuugugugaccacccaaauaauagaaaugcagauugcuauaagacccacugguugggaauucauccaaaauagagauagcuugcccuggagcgcugcagagaaaucuguguagagacugguaguggaaaauggauggauaacaacuucagaccaggacauggggaguucuguugcuggaaaaagcaacucaggcaggucuguuagaccacugcuauuuaauccuaaaacugcauacaaaucaccugggaaccuuguugagcuacagauucugauucaauagcccuggagugaggaccgagacucucugcucccaggugacgcugaugcugcccuucugaggaccacgcugugacuagcuaggccauagauagcaggucuucaucaguauaaggucagcucgccuuggguagcaaaacacugccuaagggcagcuggaggugagcccccgugggguuguuugcucagauuacaaagcuaaggucuaaaaguagaacuggauguuuucuggagagaugcuccacgcaagucuggauaaaguggaucucuugagaugugggaaugcaagcaguugccagaaggcugcuuacuccagcagauucaaguugggggcuucuagaaaucaaugccuuuccagagaaacucuugcaucaagccggcgaagauuccuaaguugguccugauuucugagugauucuccaguguuguggugugugagugaaacaccaaugaaccagcuccaaauauugagggaagacuguuggucaggaugaugugaaggagagaaggaguacagagaauaaauuacuuccacccuagcuagaauagcugccucauuuuuauugagauaaaauaaaaaggaaauugaagaauuuuccauuuacuuaacaguuaucuugccuucguguuaccaauuuuacaaggagagagaaagauaaaaaucuguggcaucuucauuucaggguguuaccuccaauuggucuguaauguaucugcuguauauauuuccuuuuuuuuccuuuuuuuuuuuuuugagacagagucucgcuguaucucccaggcuggagugcaguggugcaaucucggcucacugcaaccuccgccucccagcuucaagcaauucucaugccucagccucucaaguagcugggacuacaggcagcugccaccaugccugacuauuuuuuuuuuuuuguauuguaguagagauggguuuucaccauguugcccaggguggucuugaacuccuaagcucaggcaaucugccugccucggccucucaaagugcuaggauuauagguaugagccaccgcgcccagccugcuguguguguauguguguguguauauguauacauguauauauauauuauauauauacauauauauuauauauauauguauauauauauuauauauauacguauauauauaaaaauauauauacguauauauacauauauacuuauguauaauauauaaaaauauauaaaauauaauauauacaauauauaaauauauaaaauauauacaauauauaaauauauaaaauauaauauauacaauauauaaauauauaaaauauauaauauauacaauauauaaauauauaaaauauaauauauacaauauauaaauauauaaaauauaauauauacaauauauaaauauauaaaauauaauauauacaauauauaaauauauaaaauauauaauauauacaauauauaaauauauaaaauauauacaauauauaaauauauaaaauauauaaauauacaauauauaaauauauauaauauauacacauauaaauauaaauauuuacauauauauaaauauauauauuauauauauuuuuugagauggagucucacccugucgcccaggcuggagugcaauggcacgaucuuagcucacugcaaccuccaccuccagguuucaaacaauucuccugccucagccuccugaguagcugggacuacaggcacccaccaccacgcccugcuaauuuuuguauuuuuaguacagaugggguuucaccggguuggccaggcuggucucgaacuccugaccucgugauccaccugccucagccucccaaagugcugagauuacaggcaugagccacugugcccggccugcuguguauauuuuuaaagcaacauuuguccuauguuuuuugucuuccauucacuugaguuuuggaugggugguuacuacuacccaaaguacacacaggagcauaugaagaaaaggagagggauauuaugaaaaugugauguugaaaucaguguaacaagcauagaauuaauuugaguauauaauaaaaaguauuaaaauauauauuggaaguaaaugaguauucuaauaugcuaacuuccauauaacaguuacaaaauuuaaauggcuuacagaauuguuuagggauuuggaccuccagaaauugguuaauauuuucccuugcaaaaaucuucacuguggagucaagguaugauucagcaaugaaacagucuuucugauuacuuauguaaggcgaucaguuugcuuguuuuuuuccuuacuauaugucuuguugagcaauuauuuaucuaggaaccaucuuacaaccuauagucaacccaauggaauuuacuaaauccaucuaaagucacauuuuuaaaaauuauuauuauuauuauuuuuugagacggagucucacucuguugcccaggcuggagugcaguggugcgaucucagcucacugcaaccucugccuccuggguucaagugauucuucugccucagccuccuggaguagcugggacuacaggugcgcaccaccaugacgagccaaguuguguuuguuuguuuauuuuaguagagaugagguuucaccauauuggccaggcuggucucaaauuccugaccucgugauccgcccgccucggccucucagccucccaaagugcugggauuacaggcgugagccacugcgcucagcuaaaaauuauuauuuuugagacaggcuggaauucaguggcaccaucauggcucacggcagccucaacuccccaacccccaccacccacccacaaugcccagcuaauuuuaaaaauuuuuaaauuuuuuguagagaugugguuuccuuauguuguucaggcuaguaacaaacuccugggcucaagcaacccucccaccccagccucccaaaaugccgggauuauaagcaugagccacaggaccuuguccuuuuucaaaauuauugaggugaaauucacauaacauaaaauuaccuagguuauuuauuuuucuugcuuuguuuuguuuuuuuuuuuuuuuuuccagaaacaggaucucauuuuauugccccggcuggucuugaacuccugggcucaaacaauccucuccccgccauccaccucggccucucaaagugcugggauuauaggcaugaaccacugugcccagacaauuaccuauuuuaaagugaacaauucagaggcauuuaguauauuuacaacauuguacaaccaccacuugcaucuaguuccaaaacauuuggaucauacccaaaggaaaccccauguccauuacgcaauugcuuccaacuucccccggcagccccuggcaaccaccaaucuacuuucugaguuuguguauuuaccuguucaggguauuuccuaugaauggacucaaauggcccuuuguaaagucacaucuucuuaauaaacaucauaauuauaaaaaucuaauguuaaugagugcauauaacaggugagauauuuaauccuuacaagcuuauaaauggguaucauuauuagauagacaagaaaacuagaauuuagcuuaaaucaauacauuaaauccauaugcuugagauccauacuuacggccagagaauaaccuuuggccagacccaguuacucuagugcucuuuccaaaugccacagccgcaucucaauuuucauuucccuuaucacaaacagauggauagauacuccuucucaagcuuaacaacuucacagagcuugauucaaauacugaauguguugcuaguugcuuacagcugcuauuucucuagcagugcaguaaguccaggcaaacucuuuugaagagcucauuaaaacugcuaaaauaaagucuuagaagcaggugcauucauuagcugaaaugcagacgauuauguuaauaucgcauucaggugacaaauuuaaaggcaccaaaucaugaaggauaaaaggauuuucaaagcuaaaguuaacuucucccuuuguagagcucuuuguucugguaagcaugugacugacuacagcugucaacacgggcaccuccaaaguuaucucgcaaaaacaaagguguuuugcaguaucauacuucuuuuacaauuuccugggucucuacugaggaaaagaaagguaaggaauuaccuacaaaccuggugcuauuuuucaaauaggagaucuggcaccccauuuacaauuuaucaucagauuggucucaggggaagaggagacgcguuaaagaaggugauuaaaauauguggacagugggccgggcacgguggcucauggcuguaaucccagcauuuugggagaccgaggcggguggaucacuugaggucaggaguuugagaccagccuggccaacauggugaaaccccaucucuacuaaaagcacaaaaaguagccaggcaugguggcacgugccuguaaucccagcuacucaggaggcugaggcaggagaaucgcuugaaccugggagguggagguugcaacgagccaagaucgugccacugcacuccagccugggugacagagugagacugucuaaaaaaaaaauaaaaauguguacagugguucccaauuuggaaaagaugggcuaacaacucuuuuacuuugccuuuuuuuccuccucaauauuuugagcaugaaauauauauguaaccacauacauauuucauauguguuugggagacuguuaauaguaguuucggcugggcccgguggcucacgccuggaaucccagcacucugggagccugaggugggcggaucaugaggucaggagauugaaaccagccuggccaacguggugaaacccugucucuacuaaaaauacaaaaauuagcucagcauggcagcgcgugccuguaaucccagcuacuugggaggcugaggcaggggaaccgcuugaacccaagaggcagagguugcagugagccgagauugcaccacugcacucagccuggagacagagcuagacuccaucucaaacaacaacaacaacaacaaaaaccaguaguuucaucaggauaauuuuaauuuucuuuuuuguguauauuuuuauauuucccaaauuuucuacaaugaauauguaaauuuuuuagaaacuuuaaauguaauuuuuuuauuaaaauuuauuuuugaauuuguaauuuuucaaguuauuaaaaauuaucacuuagccucuccacauucaguuguuuuaccuauaaaguuggguuacuacugaauugcauagcacauggaagcuggaugagauguuuccccauauuccauuccuccucucaaauccaggaugucuguggaaauguggguuccucuuuagaaggcaauauaagaaaaugcagcuagguauccaaccauuuauaagaauauauaaacaagcuuaaggauuuuuaugucuuucuucagaacgucaaucaagugggcauucaucaaagcgaaugugucugucacucgcaaaggaaaaaaggcugaacaaccuuuuuaggccaaaucuacuuauuuauuuauuuauuauacaaaaaagucugugaaggcuuuguaagcuaauacucgacacauucauuuuuuuuuuuccaaaacggugugcuaaaaugacugcugacugcaaaauguaaauaaugaagcugccauagaguggcaccuacuuauggggcauguuugcauagaauguguguguguuugcuaaauagcuuguaauuaacaagcugaaaggcugcuuguacaguguaguaguccuauuuuugccugcuguccucuucagcucuucuccuucuagcuugcucuguacauuaucacuugcucuuuucucuauacaauuuagaagcccauuggcccccauuuaaaaagaaaagcaacauguaaaucaggaaaaaaaaauccccauugggaauggguuggguaagcaaagaauucuauauagauguauacauauacaccccucucccuggucaagaauggccucgcugaaucccuguuccaaaugccgugacaagucucauuagcuggagcucauugugugcagcuccuuugacugcuggacagcuccgagucuccuaggaauacuuuuccacacgccccauccuccucuguuuaauucucagagcuggcacacacacaaagguuucagaaucaagacaaagugaagaacauggccagaagagacuccuguucuuccaaaauagugcauuacuaucauaagauuagaggguaaacuucagagcacaggcuugauuguuugauugauugauuuuuuuuugagacagggucucgcuuuguugcccaggcugaagugcaguggcacagucauggcucucugcagccuugaccucuugggcucgagcaauccucccacuucagcccccugaauagcugggacuacaaaugcgugccaccaugcccaguuaauuaaaauuuuauuauuauuauuauuauuauuauuauuauuauuauuauuauuauuauuuuguaaagacagagucucauuauguugcccaggcuggucuccaacuccugggcucaagcaacucccaccucagccucccaaagugcugggguuacaggcaugaaccacugcaccuggccaagaacacaggauugaaagaugaacuugagaggucucccuagucaaguuuccuuuaaauggaugcucucuucuagagcaugccugauagucauccagccugaccuuggauaaucauccagccugaccuugaaauuuuccaaugacacaaacucucuuucauuuucccacuuuuauauagaguacuaacaguaauaaccuaauaguauaacuaauaguauaaccacaaugccaaaaaagaaaaaaaaaguaugagugauuucuaaucuaauacugccagcauuuuaaaaaucagcauguuuuuuuuuuaagacaaugucuggcucuauugcccaggcuggagugcaguggcaccaucucaggucugcaaccucugccucccaggcucaagcuguccucccaccucggccuccugaguagcugggacaacaggcccacaccaccauacuggacuaauuuuaaaaagcagcuauuuuaaaauuucuguuauugagccagaauccaggaugcagugagagugaaucauugacugaaagacacuuagaagguuuuauuggucugugguauucaucacaccacaaaggccaggcccugaaaaggaaaacuguguaaagaauguauaagccucaacaccacaguguuguccaagucuauuccuaauucauccugcuuuguugcucugacaccuguaccacaaaagaaaauuucugagauuaucuuaccuaggaaccuugucuuaaacuauauuccagcauguacaaacacuaaguugagcaaaguaggacacaugucgucaggaccuccugaggcugugucauggaaaaaaauuuuuuuuuaaagaaaagcaaaguugagcaaagcguucccaaguuaccuaaauuuugcauaugaugguauuccuucggaaugcuuugggaaguucagcaggauucugaaacaacuaaaugugacaacacaaagaacaaaaauagacaaaggaaaaaauuucaaagauaguguguccugugaaaacagucagauauccuuucuuuccacacuggcuauaugggagagucuuuuaaaauaaguuguaaugaugaaagugggguugaauuuuuuaaaagcaaauuuugaaaauuacuuagcuaauagaaaagguagaagacugugaacuauaaauuuugcuaagugaauugaacggagagguuuuaaaaaugacuauuauuuucaugaauuauaaaaaaaauucaaacaacacaaaauauuacaaagaagaagaaacaaccuuaugucccgucaccuaaaaauaauauuaucaucauaaauauuaggggaauaucauucuggauguggaaaugagagauaacuuagaauuuuaaaaacaacuuacucuuaggcaacuaagccugaucguauuguugauggccuaauugugagagacucuaaaacugacuuuuuuauaugucuguuuuauuugaaaaguuaugagaggaggggaacuaauuagaauucucaguccauaaccaaugauaagaacgugaguucaggcugggcagggagguucaccccuguaaucccagcacuuugagaggcugaggcaggagaaucccuugaguccaggauuugcccaaggaaacauaucuuauguuuuagauauagcugaauugaggguuaaagcauggacauauaaaauaaaauaaagauguuugcuaauuucuauugaacucacauuaaaaaaaaaaaaaagauagagacagggucuuaauauguugcccagacuggaguacaguagugcaaucauuagcucacuguaaccucgaaauccugggcucaagcaauccugcuuccgaaguagcugagacuacuggugcaugccaauacagaugauuuuuaaauauuuuaaauauuuuguagagauagguucucauuauguugccugggcugaucucaaacucuuggccucuucaacccaaacucuuuauuucaauacucacugaagaauauuauucuugcuuagccauacccacuucccuuggagaagaaagggcauauauuuucauuauaggugaagguggaugcuacugagaaggccuuuauauaucacaucaaggcccauuuuuacuaguuauaccucuuuuucugagcacgugaaauauuuuccugagucuuuuaauuuuuuaaaaaauugagacggagucucacucuaucacccaggcuggaguacaguggugugaucucgacucacugcaacaucugcugccaggguucaagugauucucgugucucagccucccaaguagcugggacuacaggugcgugccaccaugcccagcuaauuuuuuaaauauuuuuuagaggagacggggcuuugcuguguuggccaggcugguauggaacuccugaccucaagugaucggcccaccucagccucccaaagugcuggaauuauaggugugagccacugcacccagccuuguaauuuuuuaaauguguugcuuuuuuuugagaugaggucuugcucugcugcccaggcuggagugcaguagcaccaucucagcucugcaaccucugccuccugggcucaagccauccuccugccucagucuccugaguagcugggacuacagggcgugccacugcaccugaccuaauguguuacuuuuaaccccaguuauuuguuaagaaacucccacccugagauuccuucucuuacugaggugaagucauuuuuauuuauuuaauuauuucuuuaugaaaaggaaagaguaaaauuccccuuccucacuccuaaacaaacuucauuaaacucauauuugggcaaaaaguuuaaguagaaauuuucaaacucaaagaaaacuuugguccuuuauguugcaaaaaucaagaacauuaccuguguuaaauucaacagacauugauacugauuaugcaaauggcagauuauucauucuuuuuaaaauguguaugguagcucccccuuacuugcauuugacuaaugcuaauacaaaauuagaugccauuuccugacuuagucaccaauuuacauugagaaaauaugggucaaauagguggaagaagaaagccaauauuuccuugguaaccauuauaucaaaauugaagauaauuacuuaaucaaaaguacagauuuuccaugcaauggcucuguuuaucucaaaguauuagcacauuggacuaccugaccauuuuuccugaaaaacuaaagugcaaauaauuuuaguaaauuaaaucauauuuuuccacugacguguucuaauuuaaagauagaauuuuacuuuuaauugauccuuaacuaagaguggcacuuaacuauucucuuacuauugaugcuuauguguaucaagcaauagauuaaagccagugccacugcuacuuuguuuuacuguuauuguauuuaacgagaagccacguuguauguaaaggaguuaaagcccuacuuccaaaacacuacuuccuccuucccuaaauucaugagguggccaccucuuuuuuuuggagacagagucuugcucuguugcccaggcugauguacagcggugccaucucagcucacugcaaccuucgccuccugaauucaagcuauucucaugccucagccuccugagcagcugggauuacaggcacccaccaccacaccuggcuaacuuuuguauuuuuaguagaaacaggguuucaccauguuguccaggcuggucucaaauuccugaccucagguaauccaccugccucggccucccaaagugcugggauuauaggcgugagccaccaugcccggccccacuucaauuuuuuaauguuugaaacuucacacuucguuagcauucacuaaggcauacugaggaagcaccaacuugaauuagugaaaauuuugaaugcuauaauauaaaacuacaugaucauaucucuucaugguacaauaugcaauucuuagcagucuauagugaagaauuuccaagaagaaggcuacuacuucuaggcaccuugguaaacucauaaaaugaauaagguuacuggguaauucaucuaacacauuuuuacaauuagaaucaucauccgucuuguauacuguaucuacuuuggugccaaaugccugcauuuguuuagggcuuuacuacguauaaagcaaauuucacauaaugcuauuugauucagacacaacacuaaucauuuuggcuaccacuguuuguaugacuacuaggagugccuuaaugauaugacucuucuuuuagcuucugacaaaugaguguugcuaaguuaucugaauauguucaguuccuguucacugagcaguuacuauaugcuuggcaucaagcuagaaaauuuuuguccuuuuggguuaacaauucacucuaaauuaucauucauuuugccuggugacacuuuaucuuaugcuuuauucagcaccugucuaaauguacuuauguauucaaaagauacuuaacacuuguaauagguuacaggcacaaauuuaaaaugacuagggucugcgggugaaagucauuugccauguggaacaacacuagucaagaaauuaguuaaucaaucaguguuuugcucuaacuaauauaucuuuuucgggguuucuccacuuuggcacuauugacuuuuuuuuuuuuuuuuuuuuuuuuuuuuuuuugagauguugucuugcucugucaccaggcuggagagcagugaugugaucucagcucacugcaaccucugccucccgaguucaagcgauucaccaugcccggcuaauuuuuuguauuuuaguagagacagggguuucaccauguuggccaggauggucuugaucuccugaccuucugaucugccagccucggccucucaauaugcugggauuacaggcuugagccaccaugcccugccaaauuuuuuaauuguuguuguuguuguuauauagauuagagguuucuauguugcccaggcuggccucgaaugcauagccucaccuccuuaugcgccaggacaacaggccugagccaccgcggcucccuggcacugacauuuuagaccagaucauucuuuguucugggggacuguccugggcauuauaggauguucaacagcagcacuugccucuuuccauuagaugccaguaguaccuccacuuccaguuuugaucaucacaaacgucuccagacauugucaaauguccccaugguggaguggaggggagagagugucccugguuaaaaucacugggcuaguguggagaucaugauuucuuuacuagauuuuaaagaucuugaaggcagagacccagucugauucauugcucuaccaccucuuccccaccaacuaaauuuaguuucuggcgcagaaauguuucuugaugaauguucugaaaagaauaaaguaucuccuggaguccuccacugucgucagcccuguacaaggcaccuugguaaacccacaggaugaacaagguaacugggguaauucaucuaacaaauuugaauacaaauuuacgauuugaauaaucaucuaugucguauacugugcccacguuggugcaaaaugcuuacauuuguagagggcuuuaccauguaugaagcacauuucacauaauguuauuugauucagauaucuaaucacuuuggcuaccacuguuuauaauuuaaacucccaaguccgagcacuguauuuuuaggcaggagugggagguauuuugauuucaguggcauugccuucauuuauuaaaaggaacucuugggauugguuuaauaauaauugaauuuaaauuucagauucuuuuuugucauguuagaaguagaacaucuaaaaggcccuucaugaucuaaguaauucugguuuacuuagauuccuggaaauugccagaggauuuuaagggaggaggaaaaaaagagugaggaaauuuucccugugggcaauuggggaaaacaaaaauauuuuugugcugcggugacuucucaggaaaggaggguuggccagcagcggcugcaucugcacaaggggaauuuccacauuugggaaaacauggucauaauuaaugacuuaggaaagccaagaaaacggaccauguuggaaaaauaugaucuucaguggccaagucauugucaacugauugggccagaaaauuggauuauuuuagaaagagauauuuauuugugaauauuugucuguagguccuuccuucugugaaucuaauaagugcccugcuccugccuggagagucggcuucucauagccuuucccacucucucugucucucccuguccuaagggaagacuugcuuuagacuucuagccugaacacuggccugcagucuuuugcuuugaacaugaugcuugggucuagccaccagagauugcuggauccuaacauagcccucauuuauugaugacuccauguccugggcccugggcgaagaacacugaaaaacuaucuugauuuagacaugagaaaacugagucuuggggaauuuaagucacuuaccuaggaccaauacagcuuuaacuaccaagcuauacuucuugcaucuccucauccuguauauaaagucuacuuccuaaauuggaauguucucacucuguauacaaucucuuccccagaccgccuuguuuaaacuagaucuggccuggguugauguucauccaaguacuuccugguuaccuguucucaggaggauaagucuggguuagcaggcucagcaccaucgaaucuuggucuacuuggggaaugaauauguagucagaacauucuugcccagcuuugggguuuucuuuuauuuuagugaucaauuuuauuaaaauagguaugaucaucuuuugcuucuucuuuucauaauuuucucaagaucagggaucaggaauagcuugccaaauuucaacagguauucccaaguugaaggucaauuuuuuuuagaaagggaaauaucucuaagaaaaaaaauccuuauauuugacauguagauguaguauccaauagaacaucaacaaaaugcaguacuuuguuuugugaauugaaaaagcugcaaguuaggccgggugcgguggcucacgccuguaaucccagcacauugggaggcugaggcgggcagaucacgaggucaggaguucaagaccagccuggccaacaugguggaaccccgucucuauuaaaaauacaaacauuaggccgggcgcgguggcucaugccuguaaucccagcacuuugggaggccaaggcaggccgaucacaaggucaggagaucgagaccauccuggcuacaaaaaauuagccaggcgugguggcaggugccuguagucccagcuacucaggaggcugaggcaggagaauggcgugaacucaggaggcggagcuggcagugagccgagaucacgccacugcacucuagccuaggcgacagagcaagacuccguaucaaaaaaaaaaaaaaauuagcugggugugguggugggcaccuguaacccuagcuacuugggaggcugaggcaggagaauugcuugaacccaggaggcaaagguugcagugagccaagauugugccacugcacuccagccugggcaacagaacaagacuccgucucaaaaaaaaaaaagaaaaagaaaaagcugcaaguuaaaucaugucccucugcagcaacaauuccaugcucuagaccuuuaugaugaggcuucuaaaguuagcccugcccugugacugcaaugaaucggagaaaacaaaccuaacuaggauuuaacagucuaauugcccuggauugaaccucaaugguauuauaauuaauuuaaaaaucacaacauugggaaauaauguaauacauuucuuuucuguugaaauuaaaacauauuaauuaaaucuuauuaauauuuguuuuccgaucgcuucuugggcauagucagacauuauuaccuuuauuuggugauaugaaaacugaagggguguauuaguuuucuacuguugaguaacaaauuaucacacauucagggagguggaacaacauuucacuuauuccauagguuuugcaguucuauaggucagaaguccuggugggcuuggcugguuucucugcuuagggucccaaugagucagaaaucaagguauucaucaggcuagacucuuacgugggggcucgggggaagacucugcuuccaagccccuucagaucgcuggaggaacugaguuccuuguggcuguaacaccgaggccuuuuuaucuuuccugcugucaaccaggagccacuggcugcuccuagaggccuugcauguuuuccuucucaugcacuuucccccaucuucaccuucaaagccagcaaucacccuuaaaucuuucucaccucuggaaucucugugacuuuccucuucugcuuccagcugagaaaaacuuuuuuuuuuuuuuuuucugaaacagagucuugcucugucacccaggcuggagcgcaaaggcaugaucucugcucacugcaaccucugccuccuggguucaagcgauucuccugucucagccuccugaguagcugggacuacaggugggugccaccaugcccagcuaauuuuuguauuuuuaguagagacgggguuucgccauguugaccaggcuggucucgaacuccugaccucaggugauccaccgccucagccucccaaagugcugggauuacaggccugagccaccacucaaaaaacuauuuuuuuaaaggacucacugguuugggccaagcccucugggauaauccccauauuuuaaaguaaacuaauuuggaacuuaaauuacaucugcaaaauccuauugcagcuguaccuagauuauuguuucacaaaauaaccaggggaugggaaucuugggcagcaaucuuaaggacucugcuuaccauaaggaaauaguuacucaguuaaccugagauacaaucuagaaacagaugagcagcaguauuaaaccaaagaauuuaauuuuguauuuccuucccuuuuuuguguuuuuuaaacauauauguuuauuuguuaauauaccuguauguauguguauaauuauuauuauuauuauuguuauuauuauuauuauuuuagagauaggcucucacucuguugcccggccuggagugcagugucaaaaucauagcucacugcaaccucaaacuccuggguucaagcaaucuucuugcuucagccuccaggguaguuaggacuacaggcgugcgccaccguggccggcuaauuuuguuuauuuuuuuagagauggggucuugcuauguuuucccggcuggucucaaacuccuggccucaagcaaucuucccaccuuggccucccaaagugcugggauuaugggcaugagcccccaugcccuuccuuacuauaguauauuuugggaggcacucacccccauauuuuauuuuuauuaaugcaugauuuaaaauguugccaaggcugauuugggacauguguuuuuaagggucuauggacgucugagugguacugucgaggcuuggagcuagguguggguguguaugguagaggagauggugauggcaggugaagaagggacagaggcuaagguuuuggugaauacagaagaggcauuuacucccauuuuuaauguauucacugaagauauuugaagaugggaauccuuuuguuuucuauaggcaagucuagaaggucaaaacccaagggauucuauguguguuauuuauuuuuauuuauuuauuuauuuuugagacagagucucacucacucugucacccgggcuggagugcaguggugugauuugcagccuccaccuccccgguugaagugauucuugugccucagccuuccaaguagcugggauuacaggugugcaucaccaggcccugcuaauuuuuguguuuuuaguagagacaggguuucgucauguuggccaggcuggucuggaacuccuggccucaagugauccgcccaccucggccucccaaaguguugggauuacaggcaugagccaccgcgcuggacuauguguguuauuuaugggcaguauuugaggauguugccaaacaggcauuuuggagcauguggaucagcaucacuagcaugccaugccuuuacuacagauucaaacuucccaaguuuuugcugcacgguuucaauguaccauggccuaccagauguacuaaaggcuagaacacaggcugaguccaugggcccagcuaaccacugauccagaagccugggcccacagagggucaccuugggauugcaaaggucuggaaaaggcugagaggaucauagaaaggaagaggaucuauuaauuuuucugaucuuguaauuuuaccuggagaacagccugaugaaaaaucuaaaauucuggucaagggaguagagaugguuuuagccuuuggaaagaacauauauagaaauaugaaaaaccuaagaaaaaggcaaaauguuucagaggcuaaauauuucucacuucuucccagaauauuuagguuucccccuucuuaaaguccuggccaaaaauggagggaggggggagauuucccagauguuucuuuucaauugucccagaccuucggaaaagagugagaaaaugcuaccauauuauugggcaaagagaaguaagucaguggagagggcauuugauaacugcacugaaagagugauacaauuaggguauaaguggcauguuuaccuuuggaaaggaggacacaggaggaaagagguaggguggaagauguuaauguugcuuauucauugugaugucuuaaagcacaacacauuguauguucuuucacuggcaaagaauuuugcucuauaaagaauaacucugcuaggcaugguggcucacaccuguaaucccaauauuuugggaggcugaggcuagcagaucguuugagcccaggaguuugagagcagccugggcaacacaggaaaacccugucucaacaaaaaaauauaaacaauagcugggugugguggugcgugccuguggucacagcuacuugggaggccgaggcaggaggauugccugagccugggagguuggucgaggcugcagugagcugagauggcaccacugcacuccagccuaggugacagagugagacccugucuugaaaaauaauaauaacuaaaggauacugguaauauguuacagauauuacuuuuauucuuaauacuucuacuuaaaaaucuuucccuucauuuauucaaucauucagaaaucuuugaggagaaccugccaugugccuucaucugggugcuaggaauacgacagcaaacacaacagaugaggucccagcucucauggagcuuauauucuaguguaggggaguuggaaaaugaggaaacacuuacuuuucauuacgugauacauaaagagguaaauaugauguguuagacugugaaagguuagacagugauagcaaugcagagcaauauaauagagugaagugauagaugacaagcuggcuauuuuagacuggguggcuguggaagaccugucugaagugaugacauuugaacagugaucucaaugacagggaggagcuggucaugaaaagaucagaaugaagagcacucuacguggagagaacagaagguuccgacauccucaagauggcaagaaauuugaguuugagaaagagagagagggccuagguggcuggaacucaguggcaaaugcaaaagugguacaagaugaaguuggacaaguggacaggaccuagaucauuuaagcauggcuggccaugguaaggaauuuggauuuuuaagugagaugggaagcucucagaaaguuuuaagcaaggaaguaauuuucuguuugggcaaugaauugcagagagcaaggguggaaguccagagauguuuaggaagcaauuacaggaauucaggccaacaauggcggcuuggucuaggauacuagcagugaagaugaggagcgcuggguguaugggguguauguggaaggcagagucaaugggacuuuccgauggcuuguauguaagauauaagaaaaaggaaccaaagauauguccucuguuaucagcucgggcacuggguggauggugaugccauuuagugagacagguuggcugggaacaagaaguguagaagacucugauaaaucccucccaaauagcuguuccuuucuuccuccuugcuaacacagcccugacuuuguuuaggaugacaguuuguccagcuucaagugaugaauuaugauugcugucauucagucauaauaaucccauucccuuuugcuagauacucaauccccucaucuccuuugcagcuaggggugacucauuucuggcuaguaagcccuaagugaaagccucuggggauagauguggcuguccggaauaccaucgcaauaguuggaccuauggcagccaucuucugacuguaagacaaaagacaugaggauuaaagaccaauacaugagguacgauaaaguagaaaaaaaaauuuaccugauuccuggguaguauagaugagcagcugggucaacaccggaaaucaucuauugccaaacaucuuguuuaugaaaaaaguaaaacuauuuguuuaaaucuuguuguuugauauaagaagguuaagggaaagaaucaggaguacucuucuaaccauguugguuugagaugccuauuagauauucaugugaaagugacugccuaauuucuuccuuucuccaauggaauaaaauuuucuagaccuuuuaaaucuuagcauaggauuauagcacuagaaaacaugaagcauuggcugggcaugguggcucaugccuauaaucccagcacuuugggaggccgaggaggguggauugccugagcucaggaguuugagaacagccugggcaacacggagaaacccugucucuacuaaaaaauacaaaaaauuagcaggcguggcagcgugcaccuguagucccagcuacuugggaggcugaggcaggagaauggcuggaaccugggagguggaaguugcagugagcugagauuguaccauugcacuccagccugggggacagagugagacuguaucuccaaaaaauaaacauacaaaaaauuagccaggcaugguggugcacaccuguaguccuagcuacuugggaggcugaggugggaggaucaccugagccugagaggucaaggcugcugugagcuguguuugugccacugcacuccagccugggagaucgacugagacccugucucagaaaaagaaagagagaaagagagagagaaaggggaagggagggagggagggaggggaggggggaggggagcauuaagcauaaaagugaaugaaguugaaguggccaggagggagaccaaauuagaagcugaccaucaacauauaagacugacuucccuauuauugauagguuagcaggguugaagucguuaaaauaggaaauacaguauacuggguugguggggaaagcucagucugaggaacaggcagguucccacauuaccaaguaucuuccaucaccaugguggggcaacacuguccuggacuagaguauacauuucuaugaagauaccuucuuaccuauaugacacaguguucauguacugcuguauuuccucuccugauauauaacaaauaaucuagugaaaauuucccacuaacuuacccagggaacuauaaguaggccaaaugaagcuuuuagcacacuuucugguugcugauaaaaaucagcaacuauaaacccaauugcuccuauuuccauuagagcugcuuuccagaacuaggucuccaguuauguacauuaaaaguuugccaacccacuuauuuucuuccuaaauacuuuauuauaugcaggauggcuugggcuucaucuacagcaaacaaauauauguauauauuugccagugggccaucagaaacaucuauugauugucuauguguacaaguaacugagucugcaaaauugccuucaaaggcuaagucucuuguauucugcccuuacugagagucuguacucuccuaagguuaauuggcuuaucauauucugcuuuugugcucccuaguuuaccaugaugcuugggguuuuugccccuacgcuuuucacuuugucuuccuguaauuuauuacaaccaacccuuguguuuuuuuuuuuuuaacaguuuuggaucugcauuaauuuuuuaguccccagaggaacacuauguucccaaacauuauguucugcacucucaugcucauaucacuuuguguagugccagacaccuccugggaucucaagaaauguuguuucuuuuuaaaagaugggugauuacucuaggaggcucauaaaagaucuuucucaguugaguuacuuucacuguuuauguaucccaaguggcuuaggucaaaauauugguuaauagaaagacuccaagucuuuggagaagcuuuacuagugucuccucaucucuguaaaagcaaagaugaguauugaauggucuuacaggaguguuggagagaaaugaugaaaagcauuagaaaugagaaggccuuuguugaaaauaugaaaugccagagugaagacaguaucauuauucccaagcaggccucaguguaagcggagcucucuccaccaauugaagcuguucaucacuacaaagaauggcuguccugcaggauccuuucugcugcuggcuccuacugcagagaauagaaacuucuuucuaaauacuguauccaaaauguuuccucuucucucaacuucucagcucuauccaggacacuucacugcuuuccuccaaggcaaacuugaaccuuccucuaaauuccuucccugaaggcuguuuugaggcagagggauaggaccauggacagaggcuuagccuaccaaucacucacacagcaggaaagucaauucucuuccuaccaggaaucccugggagaggguguuuacaugaauagacucuucuuuaacuauaggucacuuuucccuucucuaacuuccuuuggagugaugcugugucuucuagaaacacugacuccuuccagcaacucucugcuccuuagacauauaagaaauacucauucuugcaaaugcaguucuuaaaauauuucaaaacaucuucauuauaaaauauuucaggcaaacagaaaacuaugaaaaauaguuuaacaaacaucuauguguaaaacagcuaccuuagcugggcgcaguggcucacgccuguaaucccagcacuuugggaggccgaggaggguggaucaccugagguugggaguucgagaccagccugaccaacauggagaaaccccaucucuacuaaaaauacaaaauuagccgggcaugauggugcaugccuguaaucccagcuacuccugaggcugaggcaggagaauugcuggaacccgggaggcggagguugcggugagccgagaucgcaccauuguacuccagccugggcaacaagagcaaaacuccgucucaaaaaaaaaaaacaaaaaacaccuaccuuaacagaucuuaauuuugacuuacuugauuuaggguuuguuugugaaaagucuuacaauacauuugaggccccuuaccuaccgccaaucacauucauuucucuauuuuucuccuucccucuuuucacaaaaguaaccauuaucuggaaguugcaauacgugauucccaugcaacuuuuauacuuuuauauuauacauauauauacauaaacaauacaaaguauuguuuuguguuuguaaaguauaaaggaaaacuauauuaugcuguauauaauauucugccguguauuuuauucauuauuauuuuuuagauguguuuauauugcagcccaaagaacuaagccauuacuuguaauuguuguacauuauucucuugcuugaauauauacagguuacuuauccuuccucuugccuuaaggaugugaagguuguuuuuaguuuguugucagugaugcuauaacaaacaaugcugcaauuaacauuuaaauaccggucuucuggugcacaccaugugagguuuuucuaggccagagucugucaaccuuguauuauugacauuuuggacuagauaauucuuugcugugggaaggauguugagcagaauuccucaccucuaacagccaagaauaucuucaaauauuaccaaauauucccuugguggggaaaaucacccuugguugaaaacgaugagucuagacaauuuaccuaagggaggaacuacaggucuuaggauucauauuaauauacaguaccauuuugcuuuccaaaaguucuguuucuccacauuuugcuaauuuuuggcauuuucagaauuuaaaaauuuugccaauuuauagguaugaaauaguugauuauuuuucuuauugcuucgcaugaguucuuuauaauuuuugaauacuaacacauggaugguuuuaugccuagcaaaauaucuccucucagucugagcuuucuuuuucuugauggucucuuuuuuaaagugguaaaauguauccauauuuuccuuuauguuuuauacuuuuauguuuuauuuaauaaguucuucccuaccccaaagguguaaacauaaugucuuguauuuuuuucuagaaguauaaaguuuuacuguucauauuuaggucuuuaaaccaacuuaaacuuacugugacaugaaacaggaaauauguauauaauuauuuccacccgccucagccucccaaagugcuaggauuacaggcaugagccacugagcccagcccucguucuccuuucuagccucaauuauuuucaaguauucauggguccucugccauagugcauagucuaagcccgucauaguaaucccauuccuuugggauugguuuuggcacgggcuucuguugcaugucuuggcaaugagaccuaaguggaauugugcuagagugggguugggaugggguggguaaguuuuccucauacugaaaaaaguacaugagaaaaagacuugcccuuccuauguuuguacaaaguuggagaaaaaugugauggcugauacuguagcagccaucuugucacucugaggggacaagcuggaaaccagcacacagagauuaacuaagcagaaagaugaaaaggucccagguccccaugaugcugcugugcuguugaaguaaccaauauuggggcuaccuaucacuggacagccuguaaucugaaauaauaaaccucuuauugcuuaagccacucuaaguuguauauuauuacuuuccaccaaaugcauguaauuuuugacccuuucguuuucuacauggacuuuguaaucacuguaccauguuccauaaucagguugggauuuuucaaauuggguuugcauugaaauuaaauauuaacuuugggagaacugacaucuuuaugauaaugaauguuuuaauucaugaauaugguauauguuuccauuuauucaaaucuucugcaauguuuuccauaagaauauuuuauauacaaaaguacauguuauauuuauuccuagacacuauauuguuuauggcuauuaaguauguuaucuuuuguuugcuaguaaauguuguaugugauaaauacugagauguaggguuacaguggaauuuuguauguugaucuuauaccaaucagcauacaagacagaguuucgcuuuguugucccagcuggagugcagucgcuugaucucagcucacugcaaccuccgccuucuggguucaagcaauucucccaccucagcccccaccaaauagcugggauuacaggaaugcaccaccacaccagcuaauuuuuguauuuuuaguagagaugggguuucaccauguuggccaggcuggucgugaccuccuaaccauaagugauccacacaccucagccucccaaaguggugggauuacaggcgugagccucugugcccagacaauuguuguuuuuuuacagacagggucucaggcuauugcccagccugguaugcaauggcaccacaauaacucacugcagccucaaauuucuggcucaagggauccuucugucucagccuccuggguagcugggacuacagacaaacaucaccacacccagcuaauuuuuagauuauccggggaucuugcccaggcuggucuugaacuccugggcucaagcaauccucccaccucagccuuccaaaguucuaggauuauaaaugugagccacugagcccagccugaauugucuuuuuaauucugauuuuauuuucagauagucuguaugauauucuucauaaacgauuacauuauccaaacaaggagaguuugucuuuucuuuuucucuacugugaugauggagauaccauggauucagucauggaggccuguaguugcuugauccaguuuccugucuguguccuuucuuccugccccaucauuccuucauguaaagccuauuaccacaugcggucagcuuauuuagccuaacaagccaguuuguuugggggggauaggggcucucagucuagcccauagguucaagcagugaaccugguuuaccacccgcuccccucacuccaugcaggucacuguuaguucccuuuaaggagucuagacgccccauucuagcauccccugccucuuuucagaccuggaaccgaaccggcccauguuuuuagccccauuuauugcuuugcauuuccggucaaaagaaaaguuuauauuugggcugggcauaguggcucaugccucuaaucccagcaguuugggaggcagaggcaggcagaucaccugaggucaggaguucaagacuagccuggccaacauggugaaacucccucucuacuaaaaauacaaaaaacuguacugaaaauacaaaaaauacaggagugcgugguggcgcacuccuguaaucccagcuacuugggaagcugaggcaggagaaucgcuuaaaaccaggaggcggagguugcagugagccgacauugcgccacugcacuccagccugggcgacagacugagucucugacucaaaaaaaaaaaaaaagaaaaaaaagaaaguuuauuauauuuggagaaaacugugucuuuuaauuuuucuccuuuauauuuuaauaaccauugcuuugugcuuagagcugagcgagugccucaaagguucagcaaugcuaccuugaccagaaaucauaauuucaaugucuauuuuguaaaggauuacagaacuagcuucuacuacugccgacacuucaugcaguaauuaucaccaaacacaaugcuacucaauuucuacaaugucuuucagguccuugugcuugguaaacacuauacuugugucugugucugucaccuggguaaugggaauggagauaaauacuauuuucugcacccgaaaaaacugaggccucuuacuaaccagacagccacaggacugugaguuccuccaaugauagggcugugccuuuuucauccugugccuccucacgaaaauaacucaaaccaaacucugggcccauaccuggcuuuauucaacaagaugucccaugaacugaggagacccccuauugagugcccucaggaucuaugcaguaccauggcuugaggaaaugagaggcuaaaaagacaggaauaagaaccaugauaguugauuuuaagcaaaauaagugagaaggaauugucgauggcauuucaucuagaaagugaauuuugauugagauuuagauauuuuuuauaugaauccccuuauauaaacuagcuuaguauauaaauauaaucaaaauagcauucauuaaaauugcaaaacuuauuuauuaaaauauguaaaacagccagcugcaacaguagugacuaagaaguauaaaaauaaauuauuuuuuucaacaaauacaaauauguauugaguuccuacuaugugcuuacacaguacaggaaauggggauacaaagauaaauaaaacagaucccugugcaacuaaaaauccaguugggccgauuguugggcaaauaaaucauccaaauaugaugggauagcuugggcacaguggcucacgccuguaaucccaacaguuugggaggcugaggcaggcagaucaccugaggucaggaguucgagaccagccuggccaacauggugaaacccugucucuacuaaaaauacaaaaauuaaccaggugugguugugggcaccuguaaucccggcuacucaggaggcugaggcaggcaaauugcuugaacccgagaggcaggcguugcagugagccgagaucgugccauggcacuccagccugggcgaaagagugaaacucugucucaaaaaacaaaacaaaacaaaauaugaugggauaggcuccuuaaaagaguguuaguuugaagaaauacuuguaccccuguguucauagcagcauuaugcacaauagccaagagguggaagcaaccuaaguguccaaugacagauuaauguguaaucgcccaaccggguucuucuugccugcugcccagaaaagucaaugcaaaacuagcagguucugcagcaaagaaagaguuuaauaaauguggggccagccaaauggaaggacaggagauaauucucaaauccgccuccccaagaaugugagggcuaggguuuuuccaggauaguuuggcaggcaggagcuagggaauggggaaugcugauugguuggguugggaugaaaucauaggggcuugaaaguguuuucuugcacugagucaguucucgggugcagguuaugggucugaguggugccaguugguucauacggaauacaaggucugaaaaauaucucaaauaccauucuuagguuuuacaauaaugauguuauccauaggggcaauuggaaaaguuauaaaucuuguuaccauucgcuacaugacuccugaguaguaaguaguuuuuaaaggcaaguuauaaaacaaugacugauuagaguuuaauuauguguauaucuuagcagaauucagaccucugucacaauucuaaccuuguggacuuacguuaguuauaugaaagugguuuuggucccugagcaaguagaggggguuaguucaggaaagaaguaucaucgucuuuguuuugaaguuaaacuaugaacuaaauuccucccauaauuagcuuggaaugagcaaguuagccugugagguuaaaacaagauguaguuaguuaugcuacauuuccuucacugucguaauuuuuguauaggugguucccaguggauaaauaaaaugugguaugugcauacaauggauuauuauucagucuuaaaaagaaaggaaauucugacacaggcuacaacauggaugaaccuugggaacaugaugccgagugaaauaagccagucacaacaagacaaauaccucaaggucucucugaccuuccaaccuuccccccgacccccgaccucuaccaaagaaauugaaguuccuuuaucugccugagaucagucuuaccaaggagaacaagcauuuucuuccccucuccggaagaccaagaauguaaccacagaugaacagacccuuucacaagauagugccugucuuucagacucauuuaugagacuaauuuaugagugugauuacacucaugugaaguaucuagaauggucaauucuuaggaacagaaagcagaauggugguugccagaagcugggggaggaaggagaaaugagaguuguuuaauggguacaaagcuucaguuuugcaagauggaaaauuuuggagauugaugguccaacaaugugaacacacuuaacacaaaugcacaguagacuuaaaagugguuaagauggcaaauuuuauauuuuggguauuuuuuaccacaauuuuaaaaauguuaaaaaaaaaaauaguguuagcauccagagggcagaggcauuucuaacaucuugcagaaugccugauauaauaguaggcacuugauaaauauuuugccuccccuugguuucugugccccauccuguguccuacacaacaggacaaaggccaagucguucugugagccaauucagcaaacaaaggcacuucucucuccaaggcacagagaagaauuucgaauauuugugauuugaaauuuguccuggucacaccaacuauucuuuacuucucagauaugcuuaucugaguucuuuuggcauuuaacuugucuaaagauagauacuguuucuacuucccaaaacagaauugugauggacuuuguaaggaaaaaaaaaaagugggaggaagucugugaaaugaaaucauuauuaggccaugguacaaauggcugucgggcccuggguucagcccagcacaggaggaagggugagguaauuagcauggauuugcaauucugcagcucgcuuuuguucccucccuccacuggcugugucugauucuagucacuggguuuauucucuuguguuuguuuuuuucacuuggccaaaaauagagagacaaaaaaaguuuccucauacuuacuucagcuuuuuacuuuuuuccuuguguguuugguuuccucuuacgugauccuuccuucuuccugccaccugcuaguuucucuaugguggggcucagaaaccaacaucccacaauauggcgcacugacaugccgcacugaggaauccucaaggucucucugaccuuccgaccuuccccccucaccuccaaucucuaccaaagaaauugaaguuccuuuaucugccugagaucagucuuaccaaggagaacaauuguuuucuuucccucuuuggaagaccaagaauguaaccacacaugaacagacccuuucacaagauagugccugucuuuccacucauuuauuauuccaaugaaaacuauuuacaaguuaauuucuaguccccauccuaucauucucccuaguaaucauuuauugccccucaacagaauucucuuucuccccacucccauaaccuguuuuauaaggaucaagcccccauuuuuuucuguaaccucaagacgguaucaaagcuucuguaucucauugggaagcuggaucuucauucugaaggcccuuguauacauguaaccguaauagguucauugcccaaugcccacgcaagucaauauaccgagacaccugguuggagcagagaaagagguuuaaucauagggucacugaacaaggagaugggagaaaaacucaaacacaucuccaggaggaauuuggaguuaggguuauuaaggguuuuggagugggccaguguggaggucaucaguugguagaagaguguagcgugacaucaugggacagggagaugaagcagcuauucgcucaugcugauccucuuccucuguggggggucuucaaauugguugcuagaauuagaggucuaaaaaacaucuuaagugauccuuaaacaaaagccuuaugauugauucugacgucagauaucccgucuggaggaacagagaggguacaaaucuucaguaucuagugacuuuuagcaacaaggaagugggccaaagugcagccugauuaaugcuuauauuuaauuaaugauauuauauaacauauuauguaauauauucuaugaaugcacuaugaaauaccuguauuucuguccagaaccuggcaugcaauucuugucaacccuguguggguaguuucaugcauaugaagucaauuuguauaccuuuucucccauguuaauccaucugccucauaucagugauuuugcagcaaaccuuuaucugcuuuuccuaccuuucucaagaauagcuuuuccuuguguucuguaacccuggcuuggugcacaguaugcgugauggacagguugaguugcaacacuuggugacaguacagacauggagccuggaaagggccugcgggguuugaauugagggaugcccauuucugguccaagcccuggguggagcuccccauuguugguucauggcccugggcgugcacauggccaagaagcagaguagagcagaggugcccugccuagugcuggaggagaaagguguccaggcaucuuccaaccuccucaugccaguaugcugagaggguaagugcaggacagagccaauggaagaccuccuuagacugggugaaucauggaaccaacugagguuuccauucuggagauuugaucaugccacuuuuuuuuuuuuuuuuuuuuuuaaagaccgaagucuggcuccaucacccacgcuggagggcaguggcaugauuuaggcucacugcaaccuccgucuucugguuuggaugauucuccugccucagccuccugaguagcugggauuacaggugugugccaccacacccggcuaauuuuuuuuuuuuuuuuuuguauuuuuaguagaggugggguuucaccauguugaccaggcuggucucgagcuccugaccuuaggugauccacccaccuuagccucccgaagugcugggauuacagguaugagucaccaugcccggccucuugccacuuuuuaaauguaacacuuaaauaguucuugcugugugacagacacuguucagacacuguucuaagugcuuuuauuuuauuuauuuauuuauuuugacauggaguguugcucugucgcccaggcuggauugugguggugugaucucggcucacugcaaccuccgccuccuggguucaagcaauuuuccuaccuuagccucuugaguagcugggacuacaggcaugcaccaccaugcccggcuaauuuuaguagagaugggguuucacuauguuggcuagggugaucuagugaucacuuuaagugaucugcccaccucggccucccgaagugcugggauuacaggccacugugccuggccucuaaguauuuuuaaauauuaacucauuuaauccuuacaacaacccugugagcuaagaacuacuauugucugaauuuuauggaugaggaaaaggaaacugaagcccagagagguuaaggacuugcucagaguuacccagcuguuacuucucugguuuauagauggcaccuuccugcuguguccccacgugguggaagaagggaagacaucucucugguauuagcaucuuuaauacccgaagucaugcuuuucacuacuccaccaugcugccacucugguuuauguagagucucccaggaucuccuuuggagauuucauggcugcuuuuacaaagcaucuccccuaagguauaacacucucuguuggguuugggcaguguguguauuccucugaaacuucugugugccuccugguguauccacuggcagucacguguucacaggcuuaauucugcagaagacaucagaaucugcccuucuuucucuccagggauaagggcacaaggaagccauuucuacccauauaaacauuuaaaaauacaauuucaggccggguacaguggcucacgccuguaaucucaacauuuugggaggccaaggcaggugaaucaccugaggucaggaguucaagaccagccuggccaacaugguaaaauccucuuugcuaaaaauacaaaaaaaaaaaaaaaaagaaagaaaauaaaaacuagccaugcaugguggugcgcaccuguuauccuaguuacuugggaggcugaggcaugagaaugguuugaaccccggagguggagguugcagagaucacgccacugcacuccacuuuuggugacagagcaagacucugucucagaaaaaaaaauaaauaaauacaguuucagcauauaacaagcacuaugcuaucuucaugguaagaagugcucugccccuacauaggaaaggauacuacuuugggaucuguugccaaucugggugaguuuauagggauucuuccccacauuccccuuucagacccuugggaacagggucaugaaauuuuuagaugguuggcuggagucaggcaaccaguucagagcuguaggacagguuuucuggugagaguagcaaacuggucuggagacaagcccaggacauuggcuuccuuacucuggaagaccguagccauagcucggaacaucacagguacucugcuaauccucugaaccuuccauaugucccucuggcugugccccagaugacuuugccuaguaaaacuggguuagcagagaagaaagauuuacaggaaguuaggaugagcuuggguuucugcugccuacacuaacccugacuuguguugcgggaccaggccucauugcuacacagagauuuuucuguggcucuuucaugccuccugucagcuugccgcucuuaauucccaaggccucugcccauucuccaucucuaaaaugcuuuuccuggaucuucuucccacagggcucucaugcugagcuggcuggaacugauagcgaauucuugcuaagaaaugagcugaucacuucugaguuacagccucagcucuauacacugcaugugcuuuuuuuguuguuguuuuuguuuuuuuugagauggagucuugcucuguugccaaggcuggaguacaguggugcgaucucggcuuacuccagccuccgccuccuggguucaagcgauucuccugacucagccuccugaguagcugggauuacaggcacacaccaccacaccugacuaauuuuuguauuuuuaauagagauggguuucaccauguuagucaggcugaucucgaacuccugaccucgugaucugcccaccuuguccucccaaagugcugggauuacaggugugagccgcugaacccaccugcauuugcaucuuaacagggacaucaaaaccaaaaaguuuaaaaacucaaagcacuggcugguguggaggcucaaaccuguaaucccagcacuuugggaagcuauuggggacaaucaaucgcuugaggccaagaauuugagaucagccugggcaacacagagaaaccugguuucuauacaaaaauuuaaaaauuagcuggggcugggugcgguagcucacaccuguaaucccagcacuuugggaggccaaggugggcagauccccuuaggucaggaguuuaagacuagccuggccaacauggcgaaaccccaucucuacuaaaaauacaaaaauuagcugggcgugguggcgagugccuguaaucccagcuacuggggaggcugaggcaggagaaucgcucgaacccaggaggcagaggcuacggugagccaagaucacaccacugcacuuuagccuggugauagagcgagacuccuucucaaaaaauaauaauaauaaaauaaaauaaagaauuaaaauaaauaaaaauuagcagggcaugguggcaugugccuguagugccagcuacuugggaggcugacgccagaggauuacuugaacccaggaguuggagguuacagugaucaugccacugcgugacagagugagacccugucucaaaaaaaaacccucaaaggagugaacaucucagguuaggauaacaggcuccuugaaauacuagagauuuggcugggcgcaguggcucaugccuguaaucccagcacuuuggggggccgaggugggcagaucaugaggucaggaaaucgagaccauccuggcuaacauggugaaaccccgucucuacuaaaaauacaaaaaauuagcugggcaugguggcaggcaccuguagucccagcuacucgggaggcugaggcaggagaauggugcgaacccgggaggcggagcuugcaaugagccaagaucgugccacugcaguccaggcugggcaacagagagacugugucucaaaaaaaaaaaaaaaaagaaauacuagagauuugggggacggugucuuuuagucuguucaggcugcuguaauaaaauaccauagacuggauggcucaugaacauguggaauuuguuugucacaguucuagagcugggaagccacagucauggcagauucggugucugguaaggccugcuuucugauccauaagcagcaccuucuugcugugucuccacaugguggaaggagggaagauaucucuccgaggucucuuuuauaaggguacuaaucagagccccucaugaccuaaucccugcucagaggauccacuccuaaaaccaugacuuuggggguuagauuuucaauacaugaaauuuggggagagacaaacacucaguccauagcagcuggagucccagccaccucauauuuuuauaugcaucuaaaaccggcccuaaugucagugucagguccaugggccuccucaaauccaagauaaaaacauucacuuuggagcaacagaucucucucuuucugaguuuguccuuaggauucagcaaauucuaagacccagaucagggcaugcuaaccaguuccauuuauuggcaacuggaguaggauccuuugucgaguuggguauuuccucugacgucacugggcuacucucaaggcuccccggugggucuuugccaggaaaaccugcauggaaaaggaggcuuggccuucgaggaagacggccuguguccuggcagacugggugugucugcuccaggcuggccucuccucauggcugcugguuuucuggacuaaugcacuuuugacccaagaagggaaaaaagguauaaacagaggagcuagagcagucagcuguuacugggugggacuugugaacuggugggcugguggcagccccagcccuuccuacucccucagagccugcuguccuuccuggccucucuaccccgccugccuuccccccucccucccucccuacuuucuccccagccacuucucauaaagaccagcugccuaggugacaccuuuugcuucuaaaaccuuccuuguuguucuuccuuggccccuuucucaaaauacaccucucucuuuccuccuucaaugccagacuguuggcaucugucucccugucuugugcaggcugccaucucuggcucaccaugguuuuauaauugccucugguuaaaguuuaaauagauggguuucagcccaagagaaaaauguaaacaagcccuuucugcagucuuucagaacugcugacuucuagugcuuuugaguucugugcuaggaaauucauuuugcuccucccuaaccaaggaacugagaaacgccauuagggcuuucagagccgugacagccucucugaaaccauugagaggcuuuuagaugauccgcacuuuuccuuuuaacucaauuaagccaucaggauccaguucccauccuagcauguuuaucuaguguauucaggugagagaauaguucagcaaaucuucauggccuggcuucugaacaggaaggaaaugaaaggaauugucauuucacuauuggaguuuuuucuaugugggagcaggggauuguauuuguugucccaggguuuuugguugaugaaguugucuugugagucaugagaaugggacuauuccuggccaguacagaaggaaaagggcaggcuggauuugagcucaugcauucugguauauauccucucauuugcuguguguuuuuguuuguugggguuuuuuuuguuuuguuguguuuuguuuuuggaaguaagugggccauuuauuuuugagucuugaugaagaauauugauuuucuauauuuuucugcuuuguauaccuuguguacuugugaucugaugucagaauggauucagcaauaauuugagauguuuuggucaaggauuugauuggaucuuugccuuucccacucaaaaaucuuccagaauuccccauuucaugcucagacuuuucuucacaaccuucuauggucgaccucaaaucuaccaucacuuuucacuauuccaaccauacacugaguucaugugagcuuuucuacccagcuccuguaacccguuucuuucccugcaguguccugacaccugggacuccuucccugcucugcucagcgucuuaucagaacguucuuccaggguucuaugaaaccuuccuugccucugggcacaaccggaaccaaccacuccucccuuuaguucuccagcacaagacaauccccuuuaugauaaggagacuuccuuucuucuuuucuuuucuuuucuuucuuuccuucucucucuuucuuucuuuuucuuucuuuuuuuucuuucuuucucucuuucuuucccucucucucuuucucccucuuucucucuuucucucuuuucucuucuuuguuucuuucuuucuuucucucuuucucucuuucuuucucuuucuuucuuucuuucuuucuuucuuucuuucuuucuuucucucuuucuuuuccuuccuuccuucccucuuucuuucuuuuuuuuugagacagaaucucacucugucacccaggcuggagugcgguggagcaaucuuggcucacuguaaccugugucucccagguucaagcaauucuccugccucagccucuggaguagcugggaucacaggaacguaccaccaugcauggcuaacuuucauauuuuuaguaaagccaggguuucaccacguuggccaggcuggucucgaacuccuggccucaaggaaucugcccgccucagccucccaaagugcugggauuacaggcuugagccaccgcgcccggccuucacucguauuucauuguuuauuaugcauccuuugcucauguggcagcuuccugcauuccaugcucuucccuuccagcgcgggaugauuuauucugucccccaguagggcccagcuucguguguggcccauaaucagagcucaauaaauauccaaucuuuguuuuucauccucuuuucaaccaaaaguuaaugucaacaauuuuuuguuguuguugagacagggucucccucuguuccccaggcuggagugcaguggugcaaccuccacucaaugcagccuuaaccucccaggcucaagacauccucccaccucagcccccugaguagcugggacuacaggugugcaccaccauacccagcuaauuuuauuuuuguagagacagguuucugccauguugccuaggcuggucucagcaauagaacauucuuaucagaacauucugauguucuuaucuuaacauucuugagcucaagaucugggcucaagugauuugaccaccucggccucccaaagugcugggauuacaggcaugaugugccaccuugcaccaaaccuuaugucaacauuuaaaaaauagcucuugggaggaaucaagaggaauaaagaaaggauuuuggagucaggcagauuuggguucaaaccucagcucugcugcucuuaguauuagggguuuuucccuaauucuuauccuuucucagccucgcuuucuucaucuauaaaaugaagacaauaagaucucuuuuauggguuuuugugagaauuaaagugaaaucaugcaaguaaagaaccagacauaguuacaucucauccuuacccucucuugaugggaaaacaguucaaauguugaaacacuguacucuggaacauaagucuuaucaaucaauuuaaaagauccaugcuacauuuucccaucauuaacacaaccuuccuugauagaacaguuucuucucacuuguacucgcaaguuuuuuaaagccuuaucuuguaaguaggauuggacuuguucaccgaaaauccaaacucuguaaaaucuucuaaagaguugauugugagccaguagaagugacuguagcccagagaaaacaaaaacccaagaauuauugaguaagugguccuaagguggucagguuauagucugguuuuauacauuuuggagaggcagggguuacaggcauagacauaaaucaauacauagaagguguacauugguucagcccaaaaaggugugacaucuggaagcagaauguagggggaggguguggggcuuaagccguagguggguuuuagggauucuuuuuuuuuuuuuaauuauacuuuaaguucugggguacaugugcagaaugugcagguuuguuacauagguauacacgugccauggugguuugcugcacccaucgauccgucaucuacauuagguauuucuccuaaugcuauuccuccucuagccccccaccugcccacaggccccagugugugaugcccaucccccacccccacacccgauugguugagagaguuaagcuauuaucuaaagaucugaaguuaguugaaagaaaugucugaguuaagguagaggaguuguggggaccaagggcuuuguuacguagaggaagccuccuauaucacagcccucugagagaauagauggucaaugucucuuuucagacauguguguguguguuguuguuguuguuguuguuuugagacaggguuucacucucuuacccaggcuggacacauguggugacaagaccacagcucacugccuccucaaccuccugggcucaggugauccuucugcuuccgcauccugaggagcugggaccacaagcccacgccuccacaggcugcugauuuuuuuuauucguaguaauggggucuugccauguugcccgggcuggugucgaacuccugggcucaagugauccuccugccucagccucccgaagugcuaggauuacaagcccaagccaccacacuuaggcggugaaucucucuuagaucuaacaaaggcuggcugcauuaacagagauucucuacagaugcagguuucccuguuucgugauggcuuugcagggcuacuucaaauuaugucaaagaaauauacuucgggguaaaauauuuugauuuccuucagggucugcuguccugugaugcuauauuagagucagguuggaaaguaagccucauuauaccagguuaauuuuuaaaaacccauuuaacaagauucugugguuuguagggugugacuuaacccuugccuggcauggccuugggucuuguuuauaauuugguaucuuacugccauaaaaagucuguuuugacagucuuauggucucuauuuuaauauuaauaugggucaguugugcccaaauccaaaagggaggagguauaaggaggugugucccaccucccuucucaucauggcugggaauucaguuuuuugggauuuucuggggcccccuuggccaaaagggggucuguuuaguuggagggcuuaguauuuuauauuugauuuacaaacuuauuuauuggucaccagaagaaaucccagugguggggaugaugaggaggcagcugcucuguuugcugcugaguuacuuucauauguagucccuuguaggggccaaagcaccuuggauguugauccgucauguugacuucugauuaaccccaguucugggaaggcuucuaagauuuccaguuuaucuguuguucuuuauguaagagcauguauuuaccauacaucuugcccuuaggucaaaacaaccuuaaucauaaauccuaccauuagucagguucacauggcauucuugccuuucccugcagggucaauuucaauugcccugugccuuccuucccuacaguauauaagcccugacugagucugggagaguaauggcauggggagccuccaucucaucuugcgacugaccgggacaucauggcuucuguuuauaugucucuuuuggccgggcacaguggcucacaccuguaaucccagcacuuugggaggccgaggcagauggaucacuugaggucaggaguucgagaccaaccuggccaacauggugaaaccccgucucuacuaaaaauacagaaguuagcugggcgugguggugacgccuguagucccagcuacuugggaggccgaggcacgagaaucguuugaaccugggaggccgagguugcagugagcggagaucguaccacugcacuccagccugggugacagagcaagacucugucucaaaaaaaaaaaaaaaaaaaaaaagguuuuaaaucugaugggccuggcagggcaggagaggagaagauaaacauuuaacuacaggauuguagcgguacagaggagggacaguuagcaugucaggaaaagauucagagaguugauacuuaggaacugagucuuaaccuaucaguacauggcugucaaaagauaguugggacaaagcacuucagguacaaccccaauucucguuucuucccccuguguaucacuacaugcagccugaagcacuuggcuccaucgucuugaaccuguacagcugucuuccccuugguccaggugacguaagggcuuccuuggaagcagcagcauuuauuagugcugguuccaaucagagaacugacauuagaacucuacuguugcucuuguggccagggccaggaaacagcuggagugguuugaacucucugcaggaggauggaugcguugaggcugggcaugugugcaugcucgugcgugcagaucugcgucugugugucuaugagucugaguguguguagguguguguccauuuggauggguggcuagauguuuauauguagguguugccaccaaaaacaaaaguagauauucagaaaacaaagugacagcucaaaaccucagacaagcugaaagacugcucagagaagggggagguugaaacaacuucaaccaaaacaaaaugaaacagagaaggaaguugcaucagaagaggaagaaugccaaugucaugcugaagaaccacaaaugucgcaaaauaaaaauaaaacgugugauucuuauuuuaccuagccaaauauuauuacaauauuuucuccuuuagaguguuaaaaauuacugaaauuauaauauuuaguucagcgaacaugaaggacacagaaaaacacaaacaaaaaauucauuccuauaauuuuuuaauguuauauacaucauauuuuauuuauuuggaucagugauugauuuuaacuuugcuuccuaccuccauauaaaaauuuuucuccagcauuuaaaaaauauuaaaaacacguucugaaauugacuuauugaagaacauguaaaaggucucauuauuagcacaaauugagaaauuauaauaaagauacucuaauagcgaagugauuaaagaugucagaacaaaaaauuauagaucccagugauguuauuaaguuuuuucauuucaguucauguagaaauguuagcuccuuugccacaaagaaauaaaagaguaguuuuccuuuugauuagauucuuguaacuacacacaugaaaaauuuauaggauugguuuaggugaggggguuuuauauauauaaacuguuaauauaacauuggaauaagcuuggcaaccaggucucagagaagucuuuugaaucuauuacuuuauaauuauagugauauugauuggcuuuccaucaccuuccuagaauuauaaugacauccaaugauuaacugauuugccaaucucgcaaauaguuaaaagaauauugaguuuuuggcagugaacuagggaaguuugugugcuuuuuguuaaaaugaaaaacuguacuccucaauugaauacauuuuuaguacauacacgaguuuaccagcaaagauaacuagagagugagcuuggugugcacacagugaaaggagcuugggagguugagauugaagugagcuacgaugccacugcacuccagccugggugacagagggagaccccaucuccaaaaaauaaauaaauaaauaaaaauaauuaauaauuaggaagagaaaagcacugaucaugaggaaaggcaaccacugaguaugaugcucacuuuaugugcuuaaagcggggacucagcaaauaauuguggaaggagggaaugagugaaaugagugcauaaauaauaaguacaaagaaaguggcguaaguguuuaauucaaaacgaaguuuagaccgggcaugguggcucuugccuguaaucucagcacuuugggaggccgaggaggaaggauuguuugagcccacgaguucgagaccagccugagcaacauagcgagauucugucuuggcaaaaaacaaacaaacaaaaaaacaaagcaaaacccaaaaaugaaauuauuagccgggcaagauaguaugugccugugguccuagcuauucgggaggcugaggugggagaucccuugagcucaggagauugagauuguagugaucuacgaugccacugcacuccagccugggugacagaaggagacccugucuccaaaaaauaaauaaauaaauaaauaaauaaauaaauaaaaauaaaguuuauauuuugcgucaugacaggguuauaacauauuuucccuaugaugcugucuuggugauacauaaguuguauacuuuucagaaguugugaggcccuuaaagaaaacaucuaccaaauuagucuggggaagaaaugaaaaucuaugcaaaacaaaguuuuuagauauuuuaaaaauauuuuacaagacuaaauucauuguuacuuuaggaacauaaaaauauaugagguauaaaaugguuuacucguagaauuauuaaauauuuaaaauuauaauuuauucaaauaauaugaauguacuaauugagacuuuuaaaaaucuuuaaaacuaauuaccaguggggcuaugaccuacuggacuuuaagacaucaaauauccuuuagcuucugccaacugagaagaaaaacaacaaaaagaggagaagccacaaacaucauaguaaaaacacauaccagaguuauguuuuuucuagaucuuccauaaggcauuuauuuucagaaaggguauaggaagaagcauuuuuuuaaauaaaaaagaaagcauuuuucuuuccuuuucuuuuuauuuuauuuuauuuuuuugagaugaagucuugcucuugucccccaggcuagagugcaaaggcaugaucuuggcucacugcaaccuccacuucccggguucaagcgauucuccugccucagccucccgaguagcugggauuacaggcaccugccaccacgcccggcuaauuuuuguauuuuuaguagagacgggguuucaccauguuggccaggcuggucuugaacuccugaccucaggugauccgccugccucggccucccaaagugcugggauuacaggugugagacaccacgcccggccuuuauuuucaaaaaauagucuaagagaguggauaggggaagaagaagaaaauuaacuaaauucauuaguuguaacuuuuucucaagcauucacauuucuguuuaacgugugaauguccccaaauaugccaguuucccugcuuccuaggcuuccagucuccagggguucuucagcugcacuaauuuccugacucagaauugccaggggucucaaguacacuccagaggacucguguaaacuggcuaggccagcuuguguucugggaagccugucuuuucuggugguguucccaagaaauaggaaagagaaaaaaugauguguggacuuagggaugaugugugauacugaguuuugcuuuacauuuuaacucuccagcucuuuccuucaaugaauggcaagccauucucaauuccagcucuucuguacugaagaauuuagcaucacuuucccuggagauccaaggaacuuugcuuuuugcccaaaauaccucucucucccaaagcaauuuccccuccucagagaaaugcugucgugucaggcugcacugcccuugaaccagacaacuuucucugcuugucuuuaucugucuaaauaaagcuaaccuacauuugcugucuaauucauucggaugcuugcugaugcuauuuaaagcaucccgcaaggcccaguggaaaacaagaugcauuaucuccaguagggaaccuuuagguuugcucaucguuuaaggaacucaagaaucuaaagaauccauucagucuucccugguucggacaugaagaacacggggcucuucacauauauauuuuuuuuauuccaggcagucuucuuugacuuauagguggcugggaucaguugauacaaaaagacguagcuagaaagucaaucucaaucauucucucucuuucacucuaucucugucucucccucuaucucucuaucucuuucucucugugucucucucucugucuuugugugugugggugagugagccugaagacaagaagacacacacacacuguguguguguguguaugugagagagagagggagagagagagagagagagcaucuucagacuucaugaaauucaacuuuucugaagauuaauuucucagcagaauguauguuucauucugggcucugaugauuguuaguccacugugaauugccucacaagaaacaaauuuaaaaguucaaaagcggcugucaccuucgugaacagacuucuggugaguuuuuggcuuguuuccaucacacucucuucagccuccauaugacgauuuguuacagaauccugguacuucuacauuccggaaaggaaaaggaaauucuccaggcguaggagcaaaaucucggggauguaaauaggacuucacugugaacuuauauaugacuggggaaaucuguuguaucuuuuuucaguuccgguauuucuguuggccugucggcuugcuuagugggagggagagagagcugguacaaugggauuguuuuaaccauuggugccccgcugcuaccuuaggcacauacuuauuaucagcauccauuuguucagcuacaauucuaugacguccauugcagugagugagucagaagccacaagcuaacaggucuauuccuucccaccgucaccuuggaaaccaaugcaucauccacaggaaaugcaggccccgauggggagugugcccagaucgaguuauaaagcuggcaaucaguuuuucaaaggaagucaaauaauaauuuguagaaucuuagucuagggugagagguggauccagccucuuggguauggauugagggcugucaggcagaaauaucacgagaaauuaaucaguuaaaauguaaguaguaaguaaaauguaagcaguaagaugucugcuugauaagaauuugaccaaaggcaagaaauauagagauaugauuugauuucucuagcaaauagcauuuauuugcccaauagcugagggucuuuuuugguaugguuguacagugugugaaaugagauaaggaaauugacaacacacaaaacaaagcuuucugcugaaugaaauguauguccccuuucucguggucacuauccccgcuaaaaaagugauggaggccaggcacgguggcucacgccuguaaucucagcacuuuggaaggccaagguaggcagaucacucgaggucagguguuugagaccaaccuguccaacauggugaaaccccgacucuacuaaaaauacaaaaauuagcugggcauggaggugcccaccuguaguccuagcuaauagggaggcugaguggggaggaucacuugaacucaggaaauggagguugcaguaagcugagauugcaccacugaacucuagccuggguaacagagugagauuccaucucaaaaaaaaauuuuaaaaaaaguagugauggagagggccgggugugauggugcaguggcucauacuuguaauuccagugcuuugggaggcauaggugggaggaucacuugaggccaggaguuuaagaccagcuugggcaacauagcaagucccugucucuacauaaaauauuuaagaauuagcugggcaugcuggugcacuccuguagucccagcuacucaggaggccuagaugggaggauaacuugagcccagcaguucaaggcugcagugagcuaugauugcacaccauugcacucuagcccgggugacagagcgagacucugucucuaaaaaagaaaagacaaaaaaaaugauggagaaaaccacagucugguuccccccaagcucucacugauuuuuuguuuguuugcuuauuuuuugccuaugccugauuuucucuuuucuugaugacugaguaugguauaauccauacacuggccuuaguguauauaugcaauuuaucacacaauguccagauaccuguggauacaaguguaguacagcugagaaaaauuaccuguacaguuucauguuguuugaugaguuuaacguuuccaggcggauuuacauucccauacuccuaugagugagagauuuuacaucaaaguacaacgugaagucucccagaacuuccugcuuuagacuuaaagcauguuagaaggcagaaaaaagaucugaaaaaucaccugguccaacuaccucauuuuucacacaggaaaugauucccagaaagguggaaugacuugucuaaggugacauaguagauauuaggauguacguuagagccagaggaaaggagauagaagagauaggaaguuugaucacaagcucuaaauuagucaacaggugauauggccaccucagagacaauaaaaauauuaggcuguauaaucgaaguaugcaguccugacuaaguggggcaauugguccaucaagggcuggucagugugugccacguuuaugauaugauguucuguucugaguacccauugaguaggaagcaaugauagaccugggugugcccagaagcagguaaagauggagauaagaguucugguaacuacaagcuaagaaaaauaauugacacauguugacuauucagccuggagaccaagggauuugucauggaagggaugggaguaucaucaaaaauaacuaaaggguggcugggugugguagcucagaucuauaauuucagcacuuugggaggccgaggcagguggaucaccugaggucaggaguucgacaccagccuggucaacauggcaaaacccugucucuacuaaaaguacaaaaauuaucugggcaugguggugggugccuauaauuccagcuacuugggaggcugaggcacgagaaucacuugaacccaggaggcggagguugcagugagcugagaucaugccacugcacuccagccugggcgacagagugagacccugucucaaaaaaaacaagcaaaaagcuaaagggcuaucuugaagaaggcucagacucaucuugugugccugcaaagggcaguccuaaauugguacuagauaaaggaugauggauauuagcuucauauaaguaauguucuaauaauucaagcugauugaaguauauuacagugacugauauaguagugaauuaauucuuugccucaggagguguucaugucuucauucaccccgaaacauuuauugagcuguugcauuauaccagucuugcuagacacuaaagacacaaugaugacuaacauggccacuuccugcaaagaguucagaaguccauuggaggucaugagaucacuuauuugcagagacaggaugaccaguaauguagaaugccaaggaagagaagcaggcacuggaaagaaagaagucuggacuacagggacucugagguugcugucuguguuaaugaagggaacacuagcugcuguaauaaucaaaccuaaaaaaugucuuauggcugaagccugaaagaaaguuuauuucacacuuaucugacauucaccaugggugugguaauaguggcugauaguggugguucucuuccaagugguaauucaaggaacuaggccacuucuaucuugugauucucccaccuucacgucuucaacauguggcacugacaggcaaugacauccugcuaacagacagggagagaacauggaggauuguguggggagguuuuuaugggcuggaccuuagaacagagaaguggugcacauaaacucuguucacauucuauccacuagaauuuaguugcauggccaccaucuagcugcaagggaggcuuagaauuuaguugagcuguuuuccuagcaaaaagaagaaccagguuuugacguaucacuagcaaaucuucuaccacacucuccaacucugagauucuaugauuaugguggcagaaccaagacaggaauuuuuaaggggugcuggggaggguggcaggguacuccauuuauuuauuuuuaaaacuuuuuauuucauuuauuuauauucauaauugacuaauaaaaaucauauauauuugugguguacaauaugauguuuuaauauaugcauacauuguggaauggcuaaaucaagcuaauuuacguauuauguguuaccucauaugcuuaucuuuuucuuuuuuuuuuucagacagggucucacucugucacccaggcuggaguguacugacacgaucauagcucauaucucacugcagccucaaacuccugggcucaagugauccuuccaccucagccucccaaguagcuagggcuauagguacaugccacacccagcugauuuuuaaauuuuuuauagagacaggggucuugcuagguugcccagacugaucucaaacucaugaccuuaagcuaucuucccaccucggucuccuaaauugcuaggauuacaggugugagcuaccacacccagcccucauuuuuuauggccagaaaggaauuuugaaguuuucuuguuugauaccagagucaucccaucccauguuuacauuaaaugucuuccuggauuggauacgguggcucaucccuguaauuccagcacuuugggaggcugaaaugggaggauugcuuaaagccaggaguuugagaccagccuggucaaccuagugagacccuaucucuuaaaagaaaaagaaaaccuuucuguugaagguguccuauuaauaauauauuguuaacuuuuaaaaagcaagguaaggccaggcuugguggcucacgccuauaaucccagcacuuugggaggcugaggcaggaugaucacucgagaccaggaguucgagaccagccugggcaacauagugagacccaucucuauaaaaaauuuaaaaauuagcaggacaugauggugcgugcuuuuagucccagcuacuuggcaggcugaggagggaagaucacuugagcccaggaagucgagacugcagugagccgugaucaugccacuguacuccagccugggugacagagcaagauccugucacaaacaaacaaacaaaacuaauggugacuauuauaaguaaaguucccccccgccagggaccugccacuucagaauacuauaaaguuaaaaggcuaccuacaaauuaaggggagguaacucuccuuaauguauaaggagcagacugugaagcugcucuaggucuacuaguaaucgugucuaacaaaucaauaauuaaaaggcaaauacucaaauauaaauauuggcaaaggauauaaaugaaaaaucauagaaagagaucucaauaacuaucaugcaaacguuuaaaaauuuuuucuccucaaaaugaagagagauaaaugaaaaauacuaucuaauauagauaaaaguacauggaaauaggaacauugauauuuuucugauggagauauuaguuggcaaaaccuuuccagagguaaauuuagaaauauuuuaaaacauuaaacucauucauacgcuauaaccuguaacuucacucuacuaauuuguccuaauaaaauauucagauaaacauaaccauuuauggcaaauaauauuaauaucagaauuuuuaugagcccagcaaaagguggauuaaaugacacaguaggcaaaugggauaccaaguugucguuaaagaacuagcuaaaagcuaaaggaaaaucuugcuaucuaauguuaagaaaaaagaaugauucaaaaauagacacagaaauguguauauaccuuacagaccuggugaauccugaaagacucuuguuaagacaaacuggcuaagagugauuuaagcuuagaaagacaccuugguccuuccaagauuuagaacuaggcagagcccucuucuugcugauauucaucccaugggccacuuuauucauaauagauccuuucauacauacugaaaaucagucauggcagcccuuggugagcaagugucauaaaguacuccuuagcaggcuaggcugugaucccagcacuuugggaggcagaggaggguggaucacuugaggccaggaguuugagaccaggcuggccaacauggugaaacccugucucuacuaaaaauacaaaaauuagccaggcaugguggcacauaccuauaauaccagcuaguugggaggcugaggcaugagaauugcuugaaccugggaggcagagauugcagugagccgagauugcaccacugcacuccagccuggaagacagaaggagacucugucuaaaaaaaaaaaaaagaaaaaagaaaaaaaaaaaaagaacaccuuagcagcccaggggcgguggcucacgccuguaauuccagcacuuugggaggccaaggugggagaauuauuugagcccaggaauucaaggccauccuggccaacauagugagaacuugucgcuacaaaaauuuuuaaaaaguagccaggugugguggccugcacauguggucccaguugcuaaggaagcugauggcaucacugcauuccagccugggugagaucuugucuaaacaaaacaaagcaaaacaaaaacaaaaacuccuuagcacugucacaacaccuagcuuuuaaguacuugaacacaauuuuagcuuucaucugaauuaaugcuuggaugauaggcagucaaaguugaugcuagcucucuaaucacauacucaguauuguuuccauuucuuugauuacuuucccucauuuucugcuaauugcuguucauugcauagaccccgccagcauuuuucacauuuugaaccuuuuugucuuuccgaaucacccuguugacuaaggauccaucucuuacccgcuugcaacacaugauuuuucuuaccacauucaaucuguuaaucuguuuuauuuucaucauaauccuaaaccuauucucaauagcacauugagcauucugaauuguuuuugcaauuaucagacacugagguuaauaauguugcaaaacaccuaagauuaaauacagcaaaucugcugguaauggaaaauuagcuggccaaggcuaagaugaccacggccaacggcuauugucaucuguugagggcaggcgaaguugaaacacuuuuacuuuuggaggaaaguauuuuccaucuccgugaaaguucacagcuggcuagguaugguggcucacgccuguaaucccagcaauuugggaggcuaaagcaggaggaucacuugaggccaggcauuugagaccaacuugggcacauagcaagacuccaucucuacaaaaaauuuuaaaaauuagcugguuaugguggggcaugccuguagucccggcuacucaggaggcugacgugugaggaucccuugagcccaggaguuugagacuaaagugagcugugauugcgccacugcccuccaggcugggugacagagugugacccugucucuuaaaaagaaaaaggaaaguuccuuuuugcuauaggcccgagggguugcugcugaaaugggcaaguucaugaaaccugggacgguggugcuuguucuggcuggaugcuauucuggaugcaaagccaucaucgugaagaacauugaugaugguaccuuagaucgccccuacagccaugcucugguggcuggaauugaccgcuguccccacaaagugacagcugccaugggcaagaagaagaucucuaagaggucaaagaucaagucuuuugugaaaguuuauaaccacaaucagcuaaugcccacaagguacucuguggauauccccuuggacaaaacugucaucaauaaggaugucuucagagacccuacucuuaaacacaaggcccgaugagaggccaaggucaaguuugaagagagauacaagacaggcaagaacaagcgguucuuccagaagcugcgguuuuagaugcuucguuuuggucauuaaaaauuaaacagaaaaaaaaaaggaaaguucacagauggccaaacuuuuccacagccaugguaccguccuagugaaguacauuugagacaauagucaucaaauuacauauaaauacguaaucaaccaaaauuauuuuuagauaguucaguugguuuacguugucugaauuggcggagucuggggguuugauuucugugucaguuacuugaagaaaaauugugccacucaaauacucuacaccuaugucuagccaugucacaaauaccugcucuucagggggccuagauacaguaugucgggagacaaucaugucauuuccgcaguccguauagaacaaugcuguuaccggccuuuguaauaaugugugaaccuggacucugcaaacucaaaaccucauguguuacccgcuugcaacacaugauuuuucuuaccacauucaaucuguuaaucuguuuuauuuucaucauaauccuaaaccuauucucaauagcacauugagcauucugaauuguuuuugcaauuaucagacacugagguuaauaauguuacaaaacaccuaagauuaaauacagcaaaucugcugguaauggaaaauuagcuggccaaggcuaagaugaccacggcuaacugcuauuggccaugcuucuauccauuaacaggaaagaagacgcuuuagucauauauuuaaauuuuuuaaaaauuaugucaggcccugcgagguagcucacgucuguaaucccagcacuuugggaggccaagguggguggaucaccugaaaucaggaguucaagaccagccuggccaacauggugaaaccccgucucuacuaaaaauacaaaaaauuagcugggcaugguggcacguuccuguaaucccagcuacucaggaggcugaggcaggagaaucgcuugaaccaggaggcagagguugaagugagccgagcugcaccgcuguacuccagccugggugacagagcaaaacccugucucaaaaaaacaaacaaacaaaaaauaugguuggaucacaagauucuccaaauguaaaacacuaaagaaagucaaaagaggcccauuuuucuaauugagauuaaaaaaaucgagugguacccgauuucccucuacuccccagggaccugaugaccauuaaugccuauugaguuaguuuucgggaauuugccgaagagcaggugggugucacuagagaauacugcauauuucucaaaguagagaaggcuacagauucacaacucagcuucuggcuucaaaugcaauuuucucccuguuuucaugacccgcuccucccuccaacgccagagcugcaggcaguucucugaauaacacuaugucccuggccuccuagcucccauuugaacguuucagcagggcuccucugaagucuggcccccaccaccuccccucucacaggcuucuuguucgucugagucagcccgugacucaccucacucauuagcggaacucagaaugccucuccauccucuggaucccuuuugucucccugcuuauaacugguuuccuggcagccuaaggucuauggacagccuugaagcuagaagguggguugcuacuaggauggucugcucaguaaagugguuggcagacagcaaguagaguuacagugacgacggugaugacggugaugacgaugaugacgaugaugcaugcaguugccucaaaaggacuuugguggccagauuuggcaugucccccuguguuggcacagggguccuugauucuuggccccuucuuuccucuuucuagucuuuucuuucccucuucauccgccccuccucugcacauaugcccgaauguacaaggugaaugcuucugggcucugcucucuguggaaaggcagggaaaagagcgacaccccuacacggcggcacccuuuccuccagccuuugcagcuccguucucauuucuacucauuugauuuuacaucccaaugcuuucuguuuuguaagagguggacuagaagggacgaaugagaaaaggcuuuacgccuuguuggugccuccugggcauauaaaaaagcccagugacaugauacuaauaagaaacucuaaauucacggucaaaaauaucagaaccaaaucacuguuauuaauuuguuaaucuuacuuaaaggccuuuguaaaauggugauacagucaagugcugcauaaugacauuucggucagugacagacugcauguacaauggugaucccauaagauuauuauacggucuuuuuuuuuuuuuuuuuugagacagagucucgcucuguugcccaggcugagagcaguggcgugaucucggcucacugcaaccucugucuccuagguucaagcaauucuccuaccucagccucccgaguagcugggauuacaggugcccacaaccacgcccagcuaauuuuugcauuuuuaguagagaugggguuucaccacauuagccaggcuggucucgaauuccugcccucaggugauccgcgccccccgcccccggccucggccucccaaagugcugggauuacaggcgugagccacugugcccggcccuauacugucuuuuuacuguaccuuuucuauguuuagauaugcuuugauacacaaauacuauuguguuacagcugccuacaguauucaguacaggagcaugucauacagguuugaagccuaggagcaauaggcuaugccauguagccuaggugugcagugggcuuaucccaucuagguuuguguaagugcacucuaugauguucaaacaacaaugaagucuccuaacaaugcauuucucagaacguaucccugucauuaaacaacgcaugacuauaguuuacucagcugaauccugacagcuuucauuaagucucaugauuuauuuugaaagggaccucagagaccauccuguccacucuuuuguucaaugggcagaugcgugauugcugugcaccugugauggucaaagcccaagccaggugcccuagggccgcacuucugaagccccugagaggcagaucuuguucuggacaccuggggagggggcccaagguccugcauuucuauaaccuccuuggggauguccgugccaucagcccacagaccacacuuugaguagcacugcugcaggcacucugcacaaagcuagauaggcuugacuugucaccggagaacauccagggccauaggcuccaugaggcggcccucugcacccugccuugucggcugcugauguuugcuugugaggcccagggaaugccaaacaauucuuccaagugcacuuggcuuucuugugucuucacccccagccagggguguuaaaaugagaagauucggguuugggauuaggacaagaaaaagggcccauaaagcuucacccuagacuaugaagucuagucuggguuaucuuagaagagagcucuaaacccacauuuuaggcagauucuguuuaacaauaaaguauuucuuugauugcuacagagaucuucuuuuaugauuuguucguucauguccuuugcugauuuuucuauugcagucuuugccuuuuaauuauugaacuguaacagcucuucauuacaauacuaaggaaaaucccccuuccuccaauaaagugauuuuagucuuuuuuuuuuuuugacuaauuuuuuguagagacgggguuuugccauguugcccaggcuggacuccuggccucaagugaugugcccgccucagccucccaaagugcugggauuacaggugugaaccacugugccuggcuguuuuuagacuuuuaacuuuaucuauuaaauucugaguuuggaaucuuggauucuaggacaaucuugcuaaucugagcaagcugcuuugcuucuugugaugugguuucuuucuguaccuguagauggagaggguaaagcugaccuaucucagggcacuguugagaguggaaugugugugugugguaguacuguacagauguagggcauaguuagcuuguuuucagagccucuauuaaucugaucacuuuauuaaaccuagugugggacauggcaaacugguguugacaaguacaaguuuuguuuuguucuguuguuuauuuugguuaaacaaacacuauggagcacuuccaaguacucugaguuguaacuucucauuguguuaagauacaugaagcagaguuggaagaugccuacugagagcuuuuuuuuaccuuuucuucuuuuucuuuuuucuuuuuuuuuuuuuugucaccauggcuggagugcaaugccgcaaucucagcucacugcaaccucugccuuccggguugaagcgauucuccugccucagccuccugaguagcugggauuacaggcacacgcaccaccacgcccagcuaauuuuuguauuuuuaguagagaugggguuucaccauguuggucaggcuggucucgaacuccugaccuugugaucugccugccugggcuucccaaagugcugggauuacagacgugagccaccaugccuggcuuacugagagcuuuauaugugugaaggugcuugugauuucuguuuaccuuugcccccucaaauacaauuauaccuucuaaguuguugacugaugccacuuccaccgcuccuaaauguccaaucaaaacugccccaguaugaggcaaaugacuggguuguuccuugguuuccacauuuccugucucaucucuguuagaaccuuacagcuguuaaaauuauuuauuucuauaguagaaguuauuagacuaguaguauucccauuugaacuggcaggguuuugucuuagcguuaagaaauagauuuguacauuucccccauuuaugauguuuaaugccuuuaacuucucucugcuacugccuuuuuuguuuuguuuuguuuuguuuuguuugugcguguguguguuugagacagggucucacucugucacccagauuggagugcaguggcaccaucauggcucacugcagccgugaacucucgggcucgagcaauccuccuaccucagccucccaaguagcugagacuacuggcaugugccaccacacucagcuaauuacauuuauuauuuauuuauuuauuuauuuauuuauuuuuguagauaugaggcuucccuauuuugcccaggcuagucucaaacuccuaggcucaagugaucugccucccucggccucccaaaaugcugggauuacagacgugagaagaaaaaaaagaauauaaucagcuacuaauaguaaaauagaaauguugaagacagugucuugccucuaauugguauuuguuuuuuaauagagucaaaggaaagagucucuacuggcaaaaauguaacucucagccagcuagagauaguuaccccucuaucucugcugguaccccaguuauccuuucuacaaacgaaauugccuuauggguucuuauacugagcauagaugcaacaacaaaaaagucaauauuauugacucucauccauuugccaagcaccgugcuaagugcuuucacauacauuuucucauuuaauggaucuuuugcuuacuuacuguaggggguagaagugagauugugccuuuguguugcuccguccucuaccuaaaggguuuaccucuguguaaacccuuuacugguagcaagggaacucaaucugaagcaaaauccauuuuuuuucucaucucguccagguucaccgugaaaaguugguugguuucucauuucuggagaagagauguguugcugauuuaggaaaaaguggauggaacagggaugaaggcugaaugcuguuuaauaccacacuauguacccacaugggugggcaccugccucugcugagaggucucucuuguccuggcuucuuucccagauaaucuauuauauucucugggaacaagaauccauauacauucaagucuuccuuugauuuacuuacuuaucuaugaacacuggucacuuaccacuuuccucaccuucucccaccccaagaaacccucuccuggagaaacauaacuggucuuuuccauuccugagauuaccugccauuuucuccucuuacaaugauuccaaaucuuggacuccacuaaggaaaacauagccugagugaaguuacacaaccagugagaaaggaaucuucccugggcaaugagaugagggcugacucacgaucucagcucuuaggaauggcucuccagcugcugacagaggccacauggguucagccaugaggucauuaaggaucucccuggugacuaacaaaauuggggcagccagggauagccagagcugagcuggggcaacugacccauuuguugaagugcccuccaggauggaggccagcaguccaaguugcaaugccuuggcaauguagcacucacagcuggugcaaucuggaggaugauuggcacccaacaaaagaagucucugguaaaggauguacuuauaaucacuguguggagacauguuuauuccagaugcccauucuucauucuuucacuuauacaacagacauuugaccuugcuaggcacugagcuggaggcugguauauuccuuguucucaaggaacugacaguuuagcagagaggcacaauggggacaagcacaggaagcauuaggagaauucagaagagcacuuaccucaaauuggagagucaggagcgcucucccaagaaugcauggaaggcuuauacagaaagggaggagaaagggcccuccagguagaguggcagcagugcccagccacagagacuagagagaacacguagcuccuuggggaugcaaaggggguuguuguggcugacaucagaauaugcaggggaaggggcaggagaugcugcuggagaggggagcauggcucagauuauaaguguccucuugcccgucaugcuggcaggucagaauucuaucuggaagggucaggaaccacuaacugacuuucugucagggaaggagaggggcaggucugccuuuugaggacguuuucucagugguuuaaugugaagauuggaugcaaagaaagcaagcaugaaguacgaggaccacuuuguagaaucaugcaguaauugaagaaggaaauaaugugggcccagccuauagcagagaccacggggaagcagaaaaagaagacugggagagauauaaaggaguugccccaacugaccauggcgaucagccacaggcgaguccugaagagcucagaggggcuucagcuuugguggcuggggggagaugaugggaggagaaggcuugcuggaaggagaugaugagugcaggcugaagcgggaacccagggaagagacccuuccaucggccugaauauuaguggaggaaggucaaggcaacucaguggaguuggggacucccccgguguccccuaaaggaggcuuggugacaauuccagaucccacuagcuagagaggaagaggcuccuaacacauggccuggcuuguuaagacugaaucuugcaggaccgaggcugcagaugagaggucucuaguaccugcagccaagcagggccugacaagcuguuuccauggagaugugguguacgcaggagggagugaguaggagggcugauccauuccagagccuugggucacaaggcuguggugggcuaacagauaaacaggaaaaagacauagucaaucagaaaaggauguucaaaacaauuugcaguuaauuggggguuguaucgucauaauucuagauuaagucuaacaauugagaaggauugggguaagccacuuaaugauccugcuaguuauuuuagguacgacuugaugagggcacagggaagcagaugccgacucaggcuaacuccaaauguacguacaccaucuuaaguccuucuacaucccuggacuccaaguugcugcauaucacucccaagugugaguaaaguaacagguuucuggagaaacagguauagauaugggaaguuaauuuuuuuuuuuguuugccaugcuaauagcaguaauacacagaaaaccugcagagcucuucagaaaacucagaugcuggugaagccucagaucagauguuguuauuaagcaauuugaagacuguucuggacagacagccagcagcaauggggcccagauguguguguguguguguguguguguguguguguaccauuuugaccaucuuaaaguguauaauucaguggcauuaaguauauucgcaaucuuguguaaccaccaucaccauuaucuauuuccaaagcuuuaccaucuuccgaaacaaaaacucuauaaucauuaagcaagaaauccccuuugagcaccaaagauauuaaacgaccuuauugugcugcaacaacacugccuaccgggcagggugauguuuugguugcugcacauaagaaagcuggguuggcuuuggccgguugcucucaauucacacauagggguuuuuggccaaaguccucaucuuauacaugagcuuauuagaccuagucuuugggaagugacugacuuuaaccauuguaaugacuguugggacuugcugaccuccaucuccaagguauucaaauggcugauggcgguacuuauuaagaucaguaaaaaugaagucaggaccauaaggcccucauaaagauucugcuggaggcaaacuuugcuccaaaguuaguugggcauaauuguaaagugaauugucuaggaagcaacauuuucuuuuuuuuuuuuuugagauaaggucuuacucaagucuugcccagauuggagugcaauggugugaacaagacucacuccagccuuguccuccugggcucaagcgauccucccaccuuagccucccaaguagccgggacuacaggcacaugccaccaugcccaagaaauucuuguauuuuuuguagagauguuuguagagauguuuugccauguuuuccagguuggucuugaacuccugggcucaagcaguccaccuaucucacccucucaaagugcugggacuacaggcaugagucaccacucccagccccaacuucauuuuaggcaaccaaaaacaacagugccuagggaagaugaggcauaauucugguuuaaaaugguagaccaugaccagaagaucagaaccugaaaucccaaauguccuauuccccuuuuuucacaaauuauauauaggccaaguuucagucuggaguucacaaacucaaagcagcaauagcccaaaagcccggacagauaccucacagaugcaugguguccaccacgaagaacaguagggggaaaaacaauggacuugauuuaaugaaaauugcuccacuauaaacacaauguaaaccacaugcauuguuuuggggaucauagugaaaggacuuuuuucuuuucuuuuuuuuuuuuuuuuugagauggagucuugcuccaucacccaggcuggagugcaauggcaugaucucggcucacugcaaccuccgcuuccuggguucaugugauucuucugccucagccucccgaguagcugggacuacaggugcaugccaccauacacggcuaauuuuuuuguauuuuuaguagagacgggguuccaucauguuagccaggauggucucaaucuccugaccucgugguccauccaccuggccucccaaaguacugggauuauaggugugagccaccgcacccaggcaagaugaauauuuuaacacaguauaguguuccugggaacuggggcucagaagagguucacuggcuuaguuagcaucaccaagaaaacuagagaaagagcuaagaaucaaguuuugucuccugauuccuggucaagugguuuauuuugauuagugucuguggugcucuguucuuggcaugcacaagggggaugguucuuagagccucuuaccaaguuuuuauuuggccagaggguaaucuauuaacacauuuauguccaaauucaccuuuaauuuaguguucauauuaugcugauuuuucaaccaaccuuggauaggagcucagacaaauguuguuagcagucaagaaaaaguuuaguguuaucaagauccuauuaggagaugauuuccaggaugguaguaugaggagcuuuacagacccagucccaaugaaacaaccauacuggugaaaauuauuuuuaagacaaccauuuaaagucucuggaaauuguccuaagggcguacaacaaaugaagaaauauuuauucaggaaaaucuacuaaauccugguaagaacaguugggaguccauggcaucugaaccaaaaacuguucccucccucccugcccaaccccaacuaggucagugugauggaagcuccaaucugaggggguguuggaaaaacagagcucccucuccucccagauaccagucaaggacuacauuaucucccuggggaggggcaggccaccagcauuucucauccucccagcuccaugcuguggaggcuaaguccuaggcaagugcagccaagaggugggugaucccauuccuccaacaagccccuaccuauagggcagaagcucucccccagauacaguagguugauaaaacuggggcuccaauuguccucaccccagcuuuuuuucagagcagagguuccacaaagggagauacaagucaagaagaccagagaccacugcccacacccaguggcccugcuuaugaaacagaaucaucacuccaagagaagugggucacugucccugccacaguuccagagcagagucucagagauucuguccaagagaagaggcaggugaugagaacagagaggccugaagcucuuccaaaaggaacuggcuuuauuuagaacagagcaugaagaaguucaagcuacagagaguucuuauaaacaacggagaauuuaaugaaaagcaaguaagaagaagcugguagcucaaugugcgcaacaagcuaaacuguaggcugauugguuuaccagggagaaccagggaaagagacagcuaagaagagccauccugaggucagaacaaaccucaaggacugaccucaaaaacuaccccagcaaagaugcuuaaauuuaauuggaacacaauguggaacaauuuacacccuagggcauuguugaaaacaauagaaugaccagcaacuagaggagccuaacaccuagggcuuauaccaacagaggcagagaacguaacagagagagagcagggaaagagacagucaaagagagcuuugcuaaaaugauugccaucccgagggggcugugcacaugaccaacccuguaccuuuugaggagcaacguuaagagauuucacacugcaggaaaauagacuucacuaaaauaaacuagccacaucacuaaagaaauaaacaaaaacaguaaguccuggguuggaaguaucaguauucagaguugcuauauuauauaacauguccaguuuucaacaacaacaaaaauacgagacauucacagaaacaggaaauguuaugugacucauaacauaacauaaggagagggaaaaguaaucaacagacuacuugagggcucagauaucagacuuagcaaacaaugacuuuaaagcacuuauauguucaaggaauuaaaggaaaccaugcuuaaagaaguaaaggaagggaugaugacaaugccucauuagauagagauuaucaauaaagaaauagauuuuuuuuuaaaaaagaaccuaauagaaauucuggaauugaaaaguacaaaacuaaagagaaaaauuaauuagaggggcccaauaguagauuugaauuggcauacgaaagaaucagcaaauuugaagauagauagagauuauuuaaucucaagaagagagaaaaaagaacgaagaaauaugaacaguaccucagaggaaugugaaauaccauuaaacacaucaacaucugcauaaugggguuaccagaagaagaggagagagagaggagcggaaaaaaauuucgaagaaacaauggcugaaauuuuuuuuuuuuuagaaagaagaucucuguugcccaggcuggagcgcaguggcacagucauggcuuacugcagccauaaccuccugggcucaagggauccuccuuccucagccuccagagcugggaauacaggcaugugccaucauaccuggcuaguuuaaaaaaauuuuuuuuuguagagacagggucuauguuucccagggcaauuuuuuaaaaaaaauuuuguggagacagggucucauuauguuucccagguggucucaaauuccuguccucaagggauccuccugccucagccucccaaagugcugagauuauaggugugaaccacugugcccaaacagcuucuaaaauuugaugaaaucuguuaucuucacauccaagaaguucaaguaacuccaaauacaauaaacacaaagagaaccauacccagacacaucagaguaaaaauguugaaagagacagauaaagagaguaucuuaaaagcagcaagggaaaaacacaaaaacacaaaaaaccaaacauacaauguauaaggaaauucaaauaagauuaacaucugacuuucuccaagaacaauggaugccagaaggcagugggauggaauauucaaaaugcugaaaggaaaauuuuuaaagccugucaacuaguuguugucuaucuaucuaucaucuaucuaucucucuauuuauuucuucagauguagucucgcucuguugcccaggcuggagugcagugaugugaucucagcucacugcaaccucugccucccagguucaaguaauucuccugccucagccuccugagcagcugggauuuuacaggugugugccaccacaucugacuaauuuuuguauuuuuaguagagacuggguuucacuguguuggccaggcuggucuugaacuccugaccucuggugagccacccgccucagccucccaaagugcugggauuacaggugugagccacugugcccgaccuauuuauuuauuuauuuauuuauuuauuuauuuauuuauuuuggagauggagucucgcucuguuuccuaggcuggagugcagugacaugaucuuagcucacugcaaccuucaccuccuggguucaagugauucuccugccucagccucccaaguagcugggacuacagacauguaccaccauacucagcuaauuuuuguauuuuuaguagagacagcauuucaccauguuguccaggcuggucucaaacuccugaccucaggugauccacccaccucggccucccaaagugcugggauuauaggugugagccaccauucccagccugucuacuaguuuuauaccagaaaaaccaucuuucacaaccacaggugaaagaaaggcauuccaagauaaacaaaaucugagauaauuuauugcuagauuacugacuuugcaagaaacagguucuucagguggaauucaagugaccccagucaguaauucauauccacauagaagaacaaaaaggacuaguaaauguaauuacauaauuauaaaagacacuauauaugcauaaucuuucucauuucuucucuuaaauuauuuuaaaagcagcuguauaaaaaauguuugacaaugacagcauaaugaggugggugggagcaaagcuacauuagaguaagaaaugacaugagaugguaacuugauugcacaggaacaaaugaagagaaccagaaaugguaaauaagaaagucgguacaucuaugagaaaagaaugaaaucauguccuuugcagcaacuuggaugcagcuggagcccauuauccuaagugaauuaaugcagaaacagaaaaccaaaugcugcacuuauaaguaggagcuaaacacuggguacacauagacacaaauauggaaauaauagacacagggacuccaaaaggguggagggagggaggagggcuaaaaaggguugaaaaacuaccuaucagguacuauguucaacuccuuaggcgaugggaucauuugaagcucaaaccucagcaucaugcaauauauccauguaacaaacuugcacauguaucccaugaauguaaaauaaaaaaauacaauuaaaauaaaagguuaguauaaccuuuauauaagcucuauacauacauacuugcuuuauuuucuccucaucuuuaaaagacauaaaaucguauuaaguaauaauuauaacaauguauuguugggcuuguaacaacacuguagacuagcuagauuuaacaaguaucuauaaaaugcuccaaccaacaacagcacaaucgauacucuucucaauugaauauggacuguucucuaggauauacuuauucuagauuauagaacaugccuuaauacauuuaaaagauuugaaguuauauaaagcaugacuucugaccacaaugacacaaaaucaaaaucaauaagacaagugugauaaauuaacaugugcagaaauuaaaugacacauuccuaaauaaacaauagguccaagaagaaauuacaaaauacuuuaaaaugaaugauaaugaaagcaaaacaaaccaaaacuuaugggaagccuaaauuuaaguugugccuaaaauggaaaugugagcugucugguaagcuggccuagaccucauagccaagaaugaagauuuauggggcauuuuucuuugcccuagucccccaaaccugaaucuugcaauuuuaucacacuucacagggugugaggauaggagagcaaccaagugcauuugggagaacagaugagaaccaaauggcuaaacuuuaucccaucucagagaaauguccucuuaacacugaggccaccuaaaaggaggaaggagaggagaagggagggaaggggaagggagagaagggaaaggaaggggaggagaggagaucuccuucucccauguggggaaaaagucuuggaugcuuagguuguuauuucagcaucaaaaaagcagagaccggguguggugguuuaugccuguaaucccaacacuuugggaggccaaggugggaggaucacuugagugcaggaguuugagaccagcccgggcaacauaaugagaccccauaucuacaaaaacauuuuaaaaucagcugggcgugguggaguguuccugucgucccagcuacuugggaggcugaggcagcaggauugcuugagccuaggaggucaaggcugcagugagccaugaucaugccacugcacuccagccugggugacagagugagacucugucucaaaaaaauuaaaaaaaaaaaaagcuccuuuuuuuuuugagaggacaccaccacagagaaaguuucacauguguaaucuuuuaacacucagugacuguacucacuguaaaucuggcccuuugccugcaaucuccuauuuauugucuccucuugcagaauuggaaagaguggguagagaaaagaguagauguuucucuccugagaugcucuguugcuggaggaagauucuguugcuggaggaagauucuguugcuggaggaaguguccuaacagagacacagagauggaaguaguggaaaagauagggucaaaccaaaccugaguaggaugccucggugaauaagaacgcuuuacaguuccuugcaaaucaaagacccauuagaggaaacuaggacacuguacauuucaauauuuccaaguaagauuuuaacccaggaaagaaacugcggaauuauuaaagcaauuuauguuuuaaagcaagguuacaauuguugguauaaaugaagugcuuugcagauguuaucagauauuuuggguaugggaagccauccauuuacauucccagagcuuuuucuuuauuagugccuugugugguuauauuuuccccuucuuuccuucuuuuaugagaucaauucuagucagaauauacuaaauaucuauucaugaaaaagaguaaggauggagaugaauuucauaaccaucuagaggagauacaaccugguggucugcuuucuauuguauugauuuguaaaagggaaaugauuuacagggugccuuugaugaaaauaaucccuuuucccucuuuuuagcucccagaaaugcaacugucuggccuuucagugugauuaagcagcuuaaacuucuagggagaaugugaggguaacaggggagccaguucuagcuggaugcaaugauucgcuguacagacugccuacacuuuggcuuuggguugaaacuucuucuccacucuuuugaacuuucuuuuuggauuuuuuaaaaaaauauauauauauaaaacaccuucaucagauuuacauagcuaugaccacucauccugugaaccccucuucuuaccauuagaaagucuggccuuccagagugcaucaccucugggaaacucauguggccaguuaagaauuccauucacaggguggauuguauagagggauuuauucacaguucccucuuucuugcauaagcccaguguacucagaaauggagacagaauagaauaguauaauggauacccaauaucugucuccuagaucaaacaguugcuaaaauuuugccacauauucuucaucuuuccuuuuccuuuuuauuuuucugagguaaaguaguauguguauacauaucuaucuaucuguagauauguauacuuauauuaauauaucaccccuaaauacuuuaacauucaccucuaaaacauaagcacauuuuuguuagcuaaacaauuucauuaucaaacuuuaauaagguucacauaauucaagagaaucaaauacucaucuacauuaaaaauuuccccuuuugucccccaaaugguuuuuuauuguaguaaaauauauauaauguaaaauuuaucauuuuaaucauuuuuaaguguacaauuuaauggcauuaaguacauucacaauauugugaaagcaucaccacuauuuccagaacuuuuuuauuauuccaaacagaaacucuacacucauuaagaauaacuccuggaaguccuagccagagcagucaggcaagagaaagaaauaaaaggcauccaaauaggaaaagaggaagucaaauuauugcucuuuguagacaauauaauucuauaucuauaaaaccccauagugucugcccaaaagcuccuagaucucuagaucugauaaauaaccucagcaaaguuucaggauacaaaacaauguacagaaaucagcagcauuuuuuuuuuuuuaagagacggggucuuacugugucgcccaggcuggaguacaguggcacgaucucagcucacugcaaccucugccucccgagcucaagcaauucugccccagccucccaaguagcugagacuacaggcacacgccaccaugccuggcuaauuuuuuuuguauuuuaguagagaugggguuucacuguguugcccaggcuggucuugaacuccugagcucaagcaauccauccaccucagccucccaaagaaaaaucagcagcauuuuuauauuccaacauccaagcugagagccaaaucaagaaugcaaucccauucacaauagccacaaaaagaauaaaauaccuaggaauacagcuagccagggagaugacuacaaugagaauuauaaaacacugaucaaagaagucagagaugacacaaaugaaaaaacauuccaugcucauggauagaaaaaaucaauaccauuaaaauggccacacugcccagagcaauuuacagaguccaugcuauuccuaucauucuucacagaauuagaaaaagcuuuuaaaauucauauggaaccaaaaaagagcuugaauagccagggcaauccuaugcaaaaagaacaaagcuggaggcaucacguuaccuguaaccaaaacagcaugguacugguacaaaaacagacacaugaggagugaaacagaauagagagggcuacaauaaccaaaacagcaugauacugguacaaaaacagacacauagaccaauggaacagaauagauagccuagaaagcugcacaccuacaaccaucugauguuugacaaagucaacaaaaacaugcaauggggaaaggauucccuguucaauaaauagugcugggauaacuggcuagccacaugcagaagauugaagcuggacuccuucuuuauauuguauacaaaaaucaacucaagauggauuaaagauuuaaauguaaaacauaaaacuauaaaaacccuggaagauaaccuaggaaauaccauuuuggacauaggcccuggcaaaaauuuugugacaaagaugccaaaagcaauugcaacaaaaacaaaaauugacaaaugggaucuaauuaagcuaaacaguuucugcacagcaaaagaaacuaucaaccaaguaaacagacaaccuacagaaugagagaaaguauuugcaaacuaugcauccggcaaaggucuaauauccagaagcuguaagagacuuaaacaaauuaacaagcaaaaaacaaccagccccauaaaaaagugggcaaaggaaaugaacagacacuuuucaaaagaagacacacauguagccaauaagcauaugaaaaaaugcucagcgucacuaacuauuagagaaacgcaaauuaaaaccacaaugagaccccaucucacaccagucacaauggcuacuauuaaaaagucaaaaaauaacaugguggugagguuguagagaaaaggcaacacuuauacauugguggugggaauguaaauuaguucacccauuguggaaagcaguguggugauuucucaaagaacugaaaacagaaguaccauuccacccagcaauuccauuauuggguguauacucaaaggaauauaaaucauucugccauaaugacacaugcaugcauauguucacugaagcacuauucacaauagcagcaaagucauggaaucaagcuaaaugcccaucagugguagacugaauaaagaaaaugugguacaucuacacuauggaauacuaugcagccauaaaaacaaaagaucauguccuuugcagcaauguggauggagcuagaggccauaguacuaagcgaacuauuaauaacauaggaacagaaaacuaaauaccacauguucucacuuauaaguaugaguacauauagacacaaaaaagagaacagcagacaugaggaccuacuggaguguggagggugggagaagggagguaacagaagaacuaccuauuggguacuaugcguauuaucugggugaugaaauaauuuguacaacaaacccuacaacaugcaauuuaccuauauaacaaauccuggaaccuaaaaaaagauuuuuuuuuaaagaauaacucggcugggcacaguggcucacgccuguaaucccagcacuuugggaggcugaggugggcaaaucacgaggucaagagaucgagaccauccuggccaacauggugaaacccugucucuacuaaaaaauacaaaaaaauuagcuggucgugguggcgugcgacuguaguaccagcuacuugggaggcugaggcaggagaauggcuugaacccgggaggcagaggaugcagugagccgagauugugccacugcacuccagccugggcgacagagcgagacuccgucucaaaaauaaaagaaaagaauaacuccccacuacccccuccuccaaaaugucuuuaauucugguuaauucaaacaagauccacuauuucauuuuguuauuauguuuuuuuuucuuuucuuuucuuuucuuuuuugagauagagucccgcucuguggcccaggcuggaaugcaguggugcgaucuccgcucacugcaaccuccaccuccuggguucaagcgauucuccucccucagccucccaaguagcugggacugcaggcaugcaccaccacaccuagcuaauuuuuguauuuuuaguagagacgggguuucaccacguuggccaggauggucuccaucugaccucgugauccgcccaccucggccucccaaagugcugggauuacaggcaugagccaccacccccagccugguuauuauguuucuuaaggcucuuuauuuagaacugucuccuuucuccacacucacauacauuuuuuuuucaugacauugaugucuugaugauucuggggcaguuguucuacagaauguucuacuuugucugauugcuucuuuaucauguucuuaaacuuguacuucuguucucugcguuucuuauaaaaagaaaguuagaccuaaaggcuugauaagagugaaacguuuugguaagaauucuucacagguaaugcuguggacuuccuacugccucauauuaggcuguacauaaugucugguuguccugguauugaugaggccaauaccgauuacuggguuaaggugacaauaugccuguugaaaguaaguuuuuaagaccgggcaugguggcucaugccuguacucccagcacuuugggaggccgagacaggauuacuuuagcccagaaguucaagaccagccuggacaauauagugagaccucaucucuacaauuauuaauaauaauaauaauaauaauaauaaaauuagcugggugugguggcauaugccuguagucccagcuacuugggaggcugaggugggaagacugcucgagccugggagauugaggcugcagugacccaugauuaugccagugcacuccagccugggcaauagagcuagacccugucucaaaauauacauauauaauaaguuucuuaaaaugaagaacugaugauugcacuuuuuuuuuuuuuugagacugagucucacuuuguagcccaggcuggagugcaguggcacgaucucggcucacugcaaccucugccucccggguucaagcgauucuccuaccucagccccaaguacuggggacuacaggugugugccaccaugcccagcuaauuuuuguauuuuuaguagagacaggguuucaccauguuggccaggcuggucucaaacuccugaccucacgugauccaccugccuuggccucucaaagugcugggauuacaggugugagccaccacgcccagccugauugcacuuucaagaaaugguuguccccacuuuaccuguucagauaaagggacucugaggaguugccuggcacccaggauauagccuuuauccuguauaaaggauaagaagauaaagacagaggcuuuuccuucuguauggaguagacacaggaguucaaguuuaucucccagaguguuccaucagggcaaaaauuucuggaauaugaggucuagcagagacuguucuuucucugggcccaguaagaagguacucugaaauugguagugagccagaauuuagccauagacaaauagaucuuuuugcuaacacuuacuaaagacagaacacuuugggaauucagauacaggagaaucuuuuauggcauuuuaaaauagcccugcccuccacuccuccccuaacuucagacaaaucacuuuagauuaccgaauaaaaaauuaaggaagagcaucuauuucagaugcagaacaaacaaaucuuaagauguuucuugaauaucauuuaaauuuagaguaaggaaaaacuaugcaucuguccucuauguuugaugcuuaccucuugucuuuuagcuacuauacacugaauaagugacccagggaaauauaaggaacuaauuuugaauaguuucauuuucaaaaguaagaauuuggguuucuaaggaaaaugaguuauuuuuaauauccauauauacacuuuuguuuuauagcaauuaaauacccacaucagguaaacucugcccaagguugcccuauauuuuuggguccccggaggguuuuuggguuuuuuuucuuuuuaguuauuauugcuuauucguguuuguuuuuuguuuuugcaguucuguuguucagcuagagaaguugugaauuuucugccuuagcaggacagacucuaaccuuaggauacuagacuaacacuuuuuguuuugcaacuggaauuaguaaaauacauuuucuccacuuauucgguaauuuuuuuuguuuuuuuugagacagagucuuacucugucacccaggcuguagugcaguggugcaaucucggcucacugcaaccuccgucucccggguucaagcaauucuccugccucagccucccgaguagcugggauuacagguacccaccaccaugucuggcuaauuuuuuuguauuuuuaguagagacgggguuucaccauguggccaggcuggccuugaacuccugaccucagguaauccaccugcuucagccucccaaagugcugggauuacaggcgugagccaccgcgccuguccuguucuguaauuuuuaaagauucugacuucacuuggguaaggagggggcaaaaguaccuuugacgaaauaaugcuucaacaauagcccucccaggggacuuaggcacacaugucucucaccaccacugggaauuacuuuauguuuggugacaaagaccccaugguaguuugcaaggccaaacaguauagucauccauccuguucucuuuucuuccucuuuaugcacagcccccuucuuucuuucuucucucuuacgucuuucuucuucugccuugcuccuucggccucuuucuccccacccacucuucuuucauuuccuccuuuugccacuccacagccuaggcuggcaugcuucccugauuccccgaugccuaccaaaugcuauguuccagaaaaauucuccugcuucacaucagcccaggguuuguuacugaacacucaauagaaucaaaggaguguaagaaucccagcggaggaggggcuguggcugggucuaugugaauucccuccuacccagcuuccguuccagguucuccaggcucuccuaguucuacaggauaguaauggcauugcuucaacuaugucuaguacuucaaaaaaagccuggaagauauuguauauuuacccucaauaaagccugaccaaguuaacuaaaauaauggaaaguuucuuuccuuuuuggggagagugggggccugagagguaggggaggucaugcagcaccaacucauugugaagacuucaucucauauucagaaguucuguggcucaugccuguaaucccaacauuuugggaggccaaggccaguggaucacaugaggccaggagucugagaccagccugaucaacauggcgaaacccuaucucuacuaacaacacaaaaauuagccagacaugguggugugcaccuguagucccagcugcuugggaggcugaggcacgagaaucgcuugaaccugggaggcagaguuugcagugagccgaggucaugccacuacacuccagccugggcaacagagcaagacugcaucucaaaaaaaaaaaaaaaaaaaaaaaucaaauugguuguguguguugucuauagaauaaagagaguauacuggaaagaauaugguagagaggugaggcugucuaccacaaccagaauuuuguuucuugcaauaguugugggcaauuuacuuaacaucucucaaccaauguacucauuuguaaaaugggacaauaauuacuauuuugcagccuacugugagaauucuagauaauauguguaagacacucauucauacaauaccuaauacacaauaaauacuuacuauguuuucuuuguaaauguaauuuauuugguagauaaaaguuuuuucaaagcauacagcucuugggggaacaacgaaucugaucacugagagaagagguugggaagcacucacguaacauaguucuacauggccacacaggucucccucaagaacugucuagucuaagggcucugacuaggggauguacaaggaagucccacauccuuuguguugaugaacagacccugucuugagggagacacucaguucccugacucaguuuccauaguuucccaugggaacuaaugccuuaccuccauuuucuuaagcuugccuauuccucugcuugauuccuaggugauugucucagaaguaccaggucugcaaguuuauggaaacuuagcauuuuagguggaaagaaaaaggacuagagugucuuggggaaaaaggauagaaggaaaguuuguggaaaguuggaagaucacacaagcuuaguuuaagccccuugaaaaugaggcaauagaauuuuuuuuuucccaaagagaaaaguacuauccuaagucaaccucucucaucucagccucacagggacucuucuaagaaaugagacuuuccggcugggcgugguagcucacgccuguaauccuagcacuuugggaggccgaggcaggcagaucacuugaggucaggaguuugagaccagcuuggccaacauggugaaaccccaucucuacuaaaauuacaaaaauuagccaggcauaguggugcacaccuguagucccagcuacuugggaggcuacagcaggagaauugcuugaacccuaaggauggagguugcgugagccaagaucccaccacugcacucuagccugggcaacaagcaagacuccaucucaaaaauaaauaaauaaauaaauaaauauacauauaaauaaaugagacuuucuucaacaucucuuaccucuucccuccaccaggguccugacuauuuccaaguucuucucucucuguaaacacccccaggauaggaagauaagguuguugcccuuccauaagugggcucagguuuacaaugaacagccagaagcuaucuagcauuuacuagaacuguggucccaggccccugcuaaacuucauuuggugggacaucuuuagagaguugaccaguagauuccagcuuuuuaaucuugguguucuguugggcaggucagaugaauuuggaauauucuguuuuaagcugaauuuaucccuuauuauuuuaagggcuguaacaaguuguuuuuuaaauguuuucagucagcauaucuuuauuuauuguccuuaauacccagaggcuacuugaagaaagacuuaauuuucaaagucugguaaguaaacaauaguuucccaauaacaucuucaggcaaacacccaaagacuucauuuucaccacagcauuuggguucuccauaauugccuauuaguauugugcucaaccacaacauuuuauaauaauuuaaaaaauauuacguaccucuaaacacaaaguuucuuaccaguuuuuuuucuucuuuuuaauuaccauguuuaacaaaagacaaaaacaagacagguuuaagugugguauugacuagacuccaaacauauuaaauaaaucacauaggcuggguuggguuucacacgagaacuaguuuggagaugguuauucacuguucucccaagaauauaaaaauguccagaggagacagugagauaaggagauacauggcuucagcucugugggaauuucuaaggcuuuaaaauucacuccagaauccugcaaaauuccuugauguugagcuuggcugcugaugccuucuuuugucuagauccucugaagccaugcacugagacuccagaaauuuacucuagucuuucuuucuacuugugaccaagaggaaaguugggcaaagggguuguauuggucagauaggcuaauuguuauaagaaaugaccuccaaauuucaaugguuugaccccaugcaaauauuguucuugucaagguccaauacggauugguagagguggagguguguggaauguggugauuugauucuaugcaguaauucaagcauauaaccuucuuccaucuuggggcucugucuuccgugggguucccagaguccuuuccauccagccaguggaaaagagagccugcagauaacugcacaggaggacuguuaugggccagaucuggaacuggcacccaucacuuucacaugccuuugacugagcucagucaauggcccuacauguugagagaggcuaggaaguacagucuagcuccaugcucagcucacagcaguuucugccacauggaaaaacagagagcuccuuagagcaggcagacagugcuguucuuguaugucgucaaagauguggaaaauaaauaugcuaacuuauuuucaguuuauuuaaugaccaaaccuaccauuaaugucucggucaguuucuggaaaaaguccaucccucaagcucacuauuaccacaaaucaguccaaacuggaacuuaacuuguucacacauaggacuuuccagaguuccaagauaccuggaccaagcccaugcagacaugcugauuguaaguugcgaacacacuugcauguugcucuucucaucagaugguucucauuacaaaaucuggcaagucaucugcccaaagccauguggcauaucuaaaccaaacuuucucacaugggaccuaugaaaagaauaaauguguuauaaacauuugaaaaacugucuucauaucuguuuuagucaguuuguguugcuaucccaaaaaacuauaaacuggguaacucguaaacaacagaaauguauugcccacaguucuagaggcuguaaaguccaagaucaggucaucagcagauuugacaucuggugagggccugccuucuaguucauagagggcgucuucuuguuguguccucacaugguggaacgggcaagcuagcucucuggggucucuuuuaugagggcaugcauuuaucccauuccuggggguucugcccucaugaccuaaucacuucucaaaggcuccacugcauaauuucaucaccuuagggguuaaguuuuaacauauaaaugugggggagacauaaacauuuagcucauugcaauaugucuucauaaaauauuuuuaaauguuuucgucuuuucucgaucaauguauuuuucacgguugucaugacuccguuacuguuugcacucuuucuuccuguuucucucauuaaccaauuuacaaaggcuauuucauaguucagcuauuuuagagacauccauuuguccucauuuacucacaggcuagcauucccauugagauuuuagcuuccucaaauaauguuuguuaucaucucauauaaagaggaugauguacaagggaacacugguaagguucugacaugcacuuugugccauuuuucuaguuauggagguaacuuuucuuuucuuuuucuuuuuauuuuauuuuauuuuauuuauuuuuugagauggagucuugcucugucauccaggcuggagugcaguggcaugauccgagcucacugcaaccuccgcuucccagguucaagcaauucuccugccucagccucccgaguagcugggacuacaggcauugccaccacacccagcuaauuuuuuguauuuuuaguagagacaggguaucaccauguuagccaggauggucucgaucucccgacuucaugauccacccgccucggccucucaaagugcugggauuacaggcaugagccaugcacccggccuauuuuuauuuuuauuuuuugagacaagaucucacuuuguugcccaggcuggagugcaguggcacaaucuuggcucacuguaaccucugccucccaguuucaagcaauucuccugccucagccucccaaguagcugggauuacagaugugcuaccaugcccagcuaaguuuuguguuuuuaguagagacaggguuucaccauguuggccaggcuugucucgaacuccugaccucaggucauccacccggcuuggccucccaaaauacugggauuauaggccugagccaccgugcccagccuauggugguaacuuuucacugguccaucuaugcuuuccuauuauaauccaaguuaugcacuuaggaugugaauuauuggguuaagggugcaaucuucauucaucuauuuauucauuucuuuuccauuuguucauuccaaaauaauuguugaguaccuaauaugagccagacagugugcuaaaugcuggagucagagcaaagaauaauagauauaaggucccuaccuucauggagcuuaugggagagaaagguucuaaauaaauguuaaugcaaaauguuaauuauaauaguaauauuuauauaaauagcuuauuuuaaaaaauggauaaccuugaaucaccuuuuuuuuuucuuuuaacuggggucuuuccuccucuguaaaaaccagcuucuuuuuaggauaaucauucauugauucuuucauuugcucacuauuuaauucaauuauuuauuuauuuauauucauucauuuguucaauaucauuguaaaacuacuccuugcuauucacuaugcuaaacugucagaacacagaaauaaaaauauaagauucgugaucgcagggaucacaguccaguugaggagacuagcauguaaacuacacaguacaacgugaugaaugucaucauggagaaaagugcaaagugcagugggaccaggaaaaggagggggccuacaucugccuaccuaggucagggaaggcuucacacaggagguagcacuucacaaaggagguagcacugaggucugaagggugaauaaaccuuugccacguugaggaaaggcaugagauggcuacuuaacaaucaaagauuugaggccuggcacgguggcucaugccuguaaucccagcacuuugggaggccgagacaggcagaucaugaggucaggagaucgagaccauccucgcuaacacggugaaaccgugucucuacuaaaaauacaaaaauuagcugggcaugguggcaggcaccuguagucccagcuacucgggaggcugaggcaggagaauggcgugaacccgggaggcggagcuugcagugagccgagaucaugccacugcauuccagccugggcgacagagugagacuccgucuccuaaaaaaaaaaaaaaaaaaauuuggccgggcaugguugcucacgccuguaaucccagcacuuugggaggcugacgcaggucaggaguuugagaccagcuuggucaacauggugaaaccccaucucuacuaaaaauacaaaaauuagccaggugugguggugcgcaccugcuguuccagcuacucaggaggcugaggcaggagaaucacuugaacccaggaggcagagguugcagugaacugagauugugccacugcacuccagcuuaggcaacaaaagcgaaacucugucucaaaaaaaaaaaaaaaucaaagauuugugcuguccuugcacaguauuacguuuauggaacuggcccaaacaacuuccaauuccccguacaucuccaugggggcaggugaccaguucucguuaguggaaugugagcagaagugauguuggucauugcugggacagacaaagacguaaguuugccuuugcuuccuucuccuuccuggcugccagcucuggaagcgaaggccucugaagcugagaggcuggcagagcuucaaaauagaaggacccuggguggaaggcuacaugcagcuguuacauggauaagaaauaaccuucuguuguguuaaucuacugacauuucauagcuugcuuguuacagcagcaagcucuaccauaauuaacccaaggcauaucaggcaaagcaaacaguaugugcaaagguuuauaaauguuucuaacauacaguacaugcucaauaaauauuuaauauugcagucaggguauuaggaggaaguacaaguaguccaauauugccaaagaauaaaauaugugacugguaggggugagaggagguuggcuggauugagaggcaugggccaaucaaaagaauuuuggcuuacccucaugggaaaagggaagccaaugaagaauaugaagaggagagaggcaugaucacuggaguagcaguguauuaguccauuuuuaugcugcugauaaagacauacuugagacugggaagaaaaagagguuuaauuggacuuacaguuccacauggcuggggaggccucagaaucauggugggaggugaaaggcacuucuuacauggugguagcaagagaaaaaugaggaagaagcaaaaguggaaaccccugauaaacccaucagaucuugugagacuuauucacuaucacgagaauaguacgggaaagaccagcccccaugguucaauuaccccuccccgggucccucccacaacacaugggaauucugggagauacaauucaaguugagauuggugggggacacagccaaaccauaucaagcagggucucugcaaaacauagcagccaagaauuucccuuaauugucuucaaauguaaaaugcuaauccaaagaggaaagagaaaggauguuagaaccagaagauaucacagucuggucaaaccuuguucaacaagugaggagagugagucccagagaaguuaaguaccuuugccaagaucacccagcuagaacuuggcagggcuggguacuagaaggcucaucccuggugccaguccuacagccuugcucuuuccacugugccacugugcuucaaagcagcugagaccagcuggugugccuguguuuucaguucccuaaugaagacacuggggauucagaggcaggguauuuuccaugggcggcuguccuuucuguaauuccucaucuggcuugagccuauuuuggaaaagguccauuuuuuuagcaucagauuucccuggaggaccacugggaaugugcuuaguggccuguggggugccccugcacuuucugaguuuuuguggagaagauaagaagaaaguagcagugguuugagcuccuggaaacucugccaggucccuuggcauuuggggaguuuguuggcucgcaaagagggacugugguucagccggccaguugacuguccuucaggggucagagcaaagcuuugucugucuaaaggaucagauaccuauggcugacuuuuuuuuuccuuuuuuuuuuuuuugugacagggucucacucugucacccaggcuggagugcaguggcauaaucauagcucauugcagcuuugacuuccuaggcucaagugauccccccaccucaggcucccaaguagcuggagcuacagcgugugccaccaugucuugcuaauuuuuuaugggcaacauagcgagaucccaucucuagaaaaaccccuggcuucaagugauccugccucggccucucaaagugcugggauuauaggugugagccaccgcgcccagccugacacuuuaauaucacuaucuuguucaucaauucacuacuucugguuuucauauauuguuaagcucauucaauauucauuauaauuguuuucacuccauguaccacccaagacaauagaucauacauuuguuuuucaauagcaaguaggaguauagggacaacugugcugaggucaggcucagagaaacaugacauguccucugacuuaaguaggaauggguauuauuaaguuauuuuacaacuaggggugcugaaacauaaguuggggacgggggaggucguuuguucaaagucuccaagauaacuggcaaaaauagauuccuugaugauuuuuggccaagaauuuuauaaucaucuuacuucuuguccuuugauuguaucaucuuugccuuccuuguguguugcccaauugccagcucaguuaguuaugauaagguauucagauaagauugcugccgggagugguggcucacgccuguaaucccagcacuuugggagggugaggcgggcaggugaucugagcccaggaguuugagaccagcuugggcaacauggcgaaaccccaucucuacaaaaaauacaaaaauuagcugaguguggugucauguaacugaggucccagcuacuggguaggcugaggggggaggaucaccugaguccaagcaggucaaggcugcagugaaccaugauugcaucacugcacuccagccugggcaacagagcaagacccugucucaaaaaaaaaaaaaaaaaaaaagaugagagaugagauugcugccucagucccugaugagugucuuggugucacucaaagacaagcucuuaagcaguggcuuugaaauuagagagacaucugacacucacuacgagaacuuaggcaaguuucuuaacuuugagccucaguuuccugcuaugugauauggggcaauaauaaacacuaauccccuguagggauuaaauaaacuaacauuuguaaagcuccuuucuuagugcugagacacacaguugucuuuuaaauuauuucccuucuuggccucugagaagaucucauuaguaacauucuguuacccacuuuccaucucuggucaagaugagaaaugagaccaaagaaugagcagauggagaccgaaauaucaccuuugucuuagucaguuuaggcugcuauaauaaaguaccauuggcugguuggcuuauaaacaacagaaauuuauuucucacaguucuggagacuggaaauccuagaucagggugccagcauggucaaguucugguaagggcaucuuccagguugcagucaauucuugcuguauccuugcuugcauugcagaaagacagcaagagagcucucugaaggcacuaaucucauucauaaggacucuacccucaugaccugaucaccucccaaaggccccaccuccuaauaccaucaccuaguuuuuuuguugucguuguuguugguuuuuuuuuuuuuuuuuuuuugagacggagucuuacucugucucccaggcuggagugcagugccaugaucucggcucacugcaaccuccaccuuccggguucaggugauucuccugccucagccucccgagcagcugcgacuacaggcaugcacuacaacgcccagcugauauauauauauauauauauauauauauauauauuuuuuuuuuuuuuuuuuuuuuuuugguacuuuuuuguauuuuuaguagagacggcuuucaccauauuggccaggcuggucucaaacuccuggccucaagugauccgccugccuuggucucucaaagugcugggauuauaggccugagccacugcgcccugcccaucaccuuguauugguuaggauaucaacauaucaauuugagagguuguuauucaguccauaaccaccuugauuacugauaaaggcuguuuauugugaaagcuaaugguacagcugaagguagacagcugaaggugauguagacuuacucaccccgucacaaguaacagcguuugaccaaggcaggccuucccaugcugggauagggagguugggucagaaagaagacccggcccacuggaggagcagggcgcaaugauauccucacucugcgcaggcagauacauaggggaagaagggaggugcuagacugugucgucuucacacauucaucaaucagauuaagucacuccucuaaggaggaagaacgagacaggcaggacagggagcuaggagugucaaacuccacagggaaggaaaccacagaagcauuuccuccagugucccccucuccuuuauucugggccuguugcuuuggaagauucaggugcuggugggaagguaaaggcagcuuccgagcacaaaagguugggagaaaaauguuggggagagagggagagcuaggguggagucaucuguagaggaagagcgaugugcacuugaauccagaaagaaaagucuaguucagagucagggguuagaggucugaagggaggucaaaguucagagaucuguucuagaugggaaagcacagcaagugcauaaccagaauuuccaggcaugggagaacauccuagggccaaaucccgagaggauggggacagcagcguuccaauggcacaugaaaggugggugaaagugauguguguguugauuuggggcacagugugguucaccauuuuucuuuucccucuucacgacaaccagugauguuucagauaauaguggcugcaucagucugggucucugaggaagauaaacuggagcagagucacagcugacuuaacguggacaagcagcaugaaugggauaaaaacuguuguuguuguaagccacugagauuugggggucauuuguucucguagcauaaucauaacuuuccugauggauaugccacuauaacauaucauuuccuucacaaaagacagugaaggagaacuuucagugacucugucugacuuuugaggaggaguauuacaaaugugacaagccuagaugugguugcugaucaguagguacaagucagucccuggcugcaugaccugcuuccacacagcagccucacuccccacgugguucagauuuaugcuuugaugacuucaugacauggaucuuuuaagucaccaaggaagagccagauauaucaaguggcuugauauauuuguacucaaugaaagcucacuaaauucuuguacaaguaucuguacucaaugaaagcucacuaaauucuuguguaauauuuaauaaguggauaagaaguuaauggaaggggaagggaacggugaacagagguugauuaauguacaaauauacaguuagaagaaagaaaaccuaauguuugauagaucaguaggaugaucuguauuguaaacuauaguuuacaacaaucaauugugcauuuuuuuuuuuuugaguuggaguuuugcucuuguugcccaggcuggaguucaauggcacaaucuuggcucauugcaaccuccgccuccuggguucaagcgauucuccugccucagccuccugaguagcuaggauuaccagcgcccaccaccaugcccugcuaauuuuuguauuuuuaguagagacgggguuucaccauguuggccaagcuggucucaaacuccugaccucaggugauccaccugccucggccucccaaaguacuaggauuacaggugugagccaccacacccggccuuuuuguauuuuuaguagagacagguuucaccguguuggccaggcuggucucaaacucuugaccucaagcgauccacccaccucagccucccaaagugcugggacuacaggcgugagccauggugccuagccaauugugcauuucaaaacggcuagaagaggauaauuuaaaugucucuagcauuuaaauauuugucuuuucuucuuuaaaagacaaauauuuaaggugauggauaucccaguuacacugauuugaucuuuacaaauuauaugaauguauuaucacauguacccucccaauauguacaccuuuuauauaucaacaaaaguaaaggaaaaaaguuaauggauuaugaucaauagauguaagaucugcccauucucuccuuuucucuucuuuuuagggcaauuuucuuuagucuuucucucuuuuccccuccuuuuccuccuuuauuuuauuuuauuuauuuuauuuuugagacaaggucuggcucuauugagcaaacuggcauacaguggcgugaucucagcucacugcaaccucugccuccuggacucaagccaaucucccaccucagcccccugaauagcugggacuacaggcacaccacgccuggcuaauuuuuguauuuuuuguagagacaggguuuugccauguugcccaggcuggucuggaacucaugagcucaagcgaucugcccaccucggccuuccaaaaugcugggauuacagguaugagccacugugccuggccaccuuauuuauuuuuuauuguuuucucuucuuuauaauccaggugauccaauaauaacuauaacuauuauuauuuaguuuaaggaggggccauauucuaaggcccuugaaugcaaagcuuguccagcuuugaagaugggacccaggcauucuuuuuccauugauaauacuuaguuuaggugcucauuauccucaucuggagcauuuuaacuagagaguaguaguugugguauuaauaguaacaauaauuauuauuaacauuuauugaaugucuacuaugaacuuuuuuuuuuuaagagacagggugucauucuguugagaucauagcucacugcagccucgaacuccuggccucaagcaguccucccagcucagccuccccaguagcuaggacuacaggcaugcaccaaccaugcccagcuaauuuuuaaaauuuaguuuuuuguagagacagggucuuacuacguugcccaggcuggucucgaacuccuggccucaagagauccucccaccucagccucccaaagugcugaauuacaggccugagccauugugccuggccuaugagguauguuuuugcaugcacuguuauucaauucuuaaaccaauccucuggacuaaauguaauuuuuauuauaaugccacuuuguagcuaggaaaugaagauugagagagauuaagugaaacuuggagguuagccaccuuucauucauccaacauccaacauauauuacugaguguuuacugugugccagacacuguuucagacaugaggcuagagcugugacuaagacuauucucaugaagcuuuuauucuagugggagaggcagauaggaaacuaguaaauuaagaaacaagaggauuucaguaaugauuaaagcuaugagaaaacuaaaauaggguaauugacaugacugacaggaguagggggagauugugcaacacuggauaagagauucagaagaccuaaauuaugugaagccaguagugcaacguuuugagguaaugaucucaugacaugcaucuuugcaaaugcaaagauccugagagagaaugagcuugguaugaucagcaacaguaauugaacuagaauucaaaacugggucauauuuuuauuucuuuuacagcuuuagugagaucuauuucacauaccauaaaaaaaguugcccauuuaaaguguaaaguuugguccaggugugguggcuaacacugguaaucccaacacuuugggaggcugagucaggaggaucacuugaggccaggacuucaagaccagccugggcaacaaagagaaacccaaucuuuacaaaaaauaaaaaaguuagcugugugguggugcacaccuguugucccagcuacucgggagguggaggugggaagaucaccugagccuggcaagguggagacugcagugaaccaugauugcaccucugcauuccagccuaggugacagagcaagacccugucucaaaaauaauaauaacaaaaauaaaguauauaguucaaugguuuuuuuacuguauuaauacuauugugcaaccaucacaacuaucuaauuuuacagccuuuucaacaucccccaaaagaccccuauacccaucagcagccauuccuuguucccauuccccacccucaagcccacuccaaccccaggcaaccacuaaucuacuugcugucucuauggauuugccuauucuggacauuugguauaaauggauucauacaauauauagucuuuugagacaggguuccuucacuuguuuuccagguucauccauguuguagcaucuaucaucaguaauuauuacuuuuuucuggcugaaaagauuccauuguauggcuauaccacauuuuguuuacccauuccucaguucauggacauggauuguuuucacguuaggccacuauaaauaaugcugcuaugagcauucacguacagguuuccauguggacauacguuuucauuucucuugguauauauauggcuaggaguagaauuccugaguaauuugguaaccguauguucagcauuuugaggaacugccaaacuguuuuccaaaguggugccaccauuucacaugcucacaagcaauagaugaggguuccaguuucuccagauccuuaccaacacuuguucuuguuauuauagccauccuuguggugugaagagaugucucacugugauuuugacuugcauuuccugaaugacgaauaauguuaaguaucuuuucaugugcauaauggccauugguauauauucuguggcagaauguuuauuuaaauuauucauccauguuuuuuuuuucuuuuaauuuuuuuuuucuuuuuugggaaagagucucacccugucacccaggcuggagugcaguggcacaaucuuggcucacagcaaccuccaccuuccggguuaaugcaauucuugugccucagccuccagaguagcugggauuaugggcuaacaccaccacacccagcuaauuuuuuguauuuuuaguagagacaggguuucacuauguugaccaggcugucuuuguccauguuuuaauugagucauuugucuuuuuauucuugaguaguaguaggguuuuaaaaauauucuggauaugagucccuugucagauacaugauuugcaaagauuuuuuccuguccuguggacugucuuuucacuuucuugaugguguuacuugaagaacaaaagauuuuacuuuugaaguucaauuuaucuauuuuuuucuuuuguuacuucugcuuuggcgacauccaagaaacuauugccaaauccaaggucaugaacauuuacucuuguuuucugauaggaguuuuauaguuuuaauucaugcauuuaggccuaugauccauuuugaguuauucuuuuuuuuuuuuguauaguguugagaguucaacuucauuuuuuuacagguauccaguugucccagcaacauuuguugaaaaaacgguucuuucccuaucgaauugucuuggcacucuucagaaauucaauucaauaccaaugugaggguuuauuuuuagucucucaagucuauuccauucaucuauauguguauccuuaugccuuaugucgugauuacuguaguuuucugguagguuuugaaaucaggaacuaugccucuuccaacuuuguucuuccucuucaagauuguuuuggcuauuuuggguuguauuuccaugugaauagcaugaucagcuugucaauuucuguaaaauaaaaaaaaaguugggauuuugauggagauugcauuggauuucauuuuucaggauuauucauugcuaguguauagaaauacaauugauuuuuguuuauugaucuuguauccugccauauuucuuuucuuuuuuuuuuuguuuacagucuugcucugucacccaggguggagcgcaguggcaugaucauagcucacugcaaccuccaacuugugagcucagcaaucaucccaucucagucuugugaguggcuaggacuacacaugcacacucagcuaauuucuaaauuuuuugcaaagaugggggucucacuauguugcccaggcuggccuugaacuccuggccucaagcguccucccaccucagccucccagagugcugggauuacagccaccaugcccagccacugccacauuucugagccuguuuuaucuuauacucuuaucauggugcuuuacugcuuacucugugggaggcaucauguuagacacuagaaauaaaaagaugggcugggcaugguggcucaugccuguaaucccagcacuuugggaggccaaggcggguggauuaccugaguuugggaguuugagaccagccugaccaacauggagaaacuucaucucuacuaaaaauacaaaauuagcugggcaugguggcgcaugccuguaaucccagcuacuugggaggcugaggcaggagaaucgcuugaacccgggaggcggagguuguggugagccgagauagugccauugcacuccagccugggcaacaagagugaaacuccgucucaaaaaaaaaaaaaaaaaaaagaaagaugaagaaaacauggucuuuguccugaagaagcuuauagccuaauucaaaaaguaagacauaaacuuauugauuaaacaguagcccuugacagcaacauacagggaaguacauaauugccaaaugaauguuaccagaugauuagagaucuagcaaguucaggggaugaggagggacguggaggcuauagaggucuaggagaaauagaggaggagggaucugagcuggguucgaaggcucaccuccuucccuuccuucuuucuccccuuccuucuuuaauuuucuuauuuccuuuucucccuuuucucuuccuacccaucuucuuugaaaacauuaauagaauauaaccaugguugguuaucauuucucaaaccuggcgaucaucagaaucucuuggcaagccuuuuaaauauacagauuccagagucucaugucagaccuauuguaucauauucucagaugguggggcauggacaacugcauuaaaaguuuuaucugauuuucagccagguuuggaaauuucuggauaugacuauagucaugauuuccacacguggaccaauccucaucuucauuccacugcagcucugacucuguuuaggaugcucacaaggccagcaggucacacgggcaccuaguaagggaggggaauugggccugugcaacagcuccuccguucaugaacagcaucucaaucugcauacguuacugagagggcucuucagugucauuuauguuuauggggauggcucauuauacagaucaaacuuuuauuuucuguaacugagaaucuaagaaucucaaaagauccuuccgcugucgauggccaugacccucagaguuaccugugggauauggacucauuauccagauuuaauaaauaauaacggcuugccaugauaaaaccuucuaguuacaagagaaggcccuucccucccucccucccucccucccuccuucccuucccuuccccuccuuccuuccuuccuuccuuccuuccuuccuuccuuccuuccuuccuuccuuccucucucucucuuuacugcuuucuuucuucucuuuuuuuuuuuuuuugagacagcaucucacucuguugcccaaaacaggcuggaguacacuggugcacucacagcucacugcagccuugaccuccugggcucaggugauccucccaccucagccucccgaguagcugggacuacaggcaugcaccaccacagcuggcuaauuuuuguauuuuuuguagaaacaggguuucaugauguugcucaggcuggucuagaacuccugggcugaagcugucugcgcaucuuggccucccaaaaaugcugggauaacaggcgugugccauugugcccggccgagaaggcccuuucauuucaacucucuccagagguaaccaaucuguugaagacugugaguguccuucccacauguuuuuauaguuuuacuacacaauaggcaaguuuugcauguuuaaaccuguauguaaauaguguacauauuuuuuucuguagcuuuuuuucucaacauugugauuuggagauuuaucugugguacuuguagagcuaauccauucuauauaacauaacauuauauuauauaauacugcaauguagugcuccauuguguaaauguucuagaaucuauucuccuguggguggauauuuguuauggccaguuuuuugcuauuccaaaucaugauguaaaucaugcccugguguacgucuccuugaacacaugugugagaguucuagggaauauaucuagaacaaaaauugcuagggaauaggauaugcgcacuuccgacuugacuagauugccuuccagcuuacuguccacagcagcugaaccaauuguuauauaucucaucaaugauauacaagaauuugucuugucccacauucuaaccaacgcugucaaguuuuuuaaaaauacacauaucuaagcccuauuuucauagauucugauagguucacucuggagugugguuugaaauaggcuacaggugguucuaaaacacaaauaaaguuaagucugcuccaaguaugcauguguauaugaucuaauauauugauauguggauugucacgcugagguuacucuggugcucuguugguagcaucuauguuggcuggauuuagauguuugaggaaaggguggggaaguaccacuguccaacauacagauacacuuugaauaaaaaagcggucugugauuuaccagugcacugggcuguaguugaucuaaagcccuaccuuugccagcuacgugaauagggugggcccuuucuaagugcugccuucccucucaccagguguguggcuggguaucagcugucagggcuugcauacgugcggucgcuuagggcaaggugccugucagcuaugucugccagcccgcuggguggugucacuguguggagcauuuguggcuuuuucaaagcccugaggaaucugagaagcaagugaggggaaugaugcaugaaaacaaaaggcaguggaaagagugaccagccagcaggcuccagcaggcuagaacgcucuguccuuguuauuacugcuucaggaaaaugcugccagcuuccuggcagggccuggaagguagaggcuucuugagaaaacaaggauaagugaugcguacucugaggcugagauuccgguuccccagccuccccgcuuuuccagcagaagcugcagggugaggauggggaaccguuugcuccuugguggguuuggccagucuuucauucucuccuggcugcuguccuaagaguuuuuucuccuuucuuccacucauaagcagcacggcucuggucucagaggccuagcagggcuggccugggagggaagcugggcggugcccuaggcagaguuguucccugaggagugaugugaaggucagccuaggggaggaaaaagggccucagccauaauucccauucaaggaguguuugccaaagaugaaccuccugguguggggcaaugagacacgggaugcgcucauaccuuguccacuuucccccugguacugcauucacaggauagccuaacccaauuuuccgaaaugagguagaagcucagcaaagguaagcguuuccauguuaacuuauuaucagauggaugugaggaccugucguaauuggacuugccgaaagucaacuucuauuuucccuccugacaaucaccuuucuuuggcauauaaaauacauggaugcaaauuagggaagaagucagcauucuuuucuucucuuaaaaaguagcgaugaggauaaagaauaaaaauaggccucuguagauacaauagggcugagcugagggugugguuugcuuggcaacagcucaggcaaagcuguuucucuugguccuggaaugcccuugacuucaccucugccugaugcagucuuaagagaccagcuugauugugaguuuuuuuggugaaacucccaucaauaguuagucauucccuuuuuucuggccccauagcauuuugcucuuauaaaaaccauucaucauauugcgugacaauuacugacuugggaucaugccuuauucucugcguguguuuccucagcaucuauggacuuuuuuuuuuuuuuuugagacacaguuucacucugucgcccaggcuggagugcaguggcgccgucucacugcaaccuucgucucccggguucaagcgauucucgugccuccaccucccaaggagcugggauuacaggcaugcguuaucacgccggacuaauuuuguauuuuuaguagagacaggguuucaccauguuggccaggcuggucucgaacuccugaucucaagugaucugucugccuuggccucucaaagugcugggauuacaggugugagccacugcgccuggccaauggacuauauuuuaacauaguaguucuuugauaaauguuuauugaaugaauccaaguuccuaagaagauaucaguccucagcucuuauauuuucuuaauuauccccugccuuuuccuuuguggggugaucugcaagcaguuucaucugcacguggaauggaggacaugcuaaaaguaaauguagcuuuguuuuuuuuuccucccccaaggaauugccucaguaggaauggguguuucagauauaucauucuguuacagguacaaaaaauuguuuccaggaagcacugccaucauuaucucugagaggcaagucaguagaaauuguuauuuuccauuuacagauggacaaauggaagguuucuuucucauuuaccaauuacagaauguccacucuguuuaaaguacugugcuaagauuuuuaugggcuacaaagauguacaagacaagguucuuguuucgaauaagaaugucauaaucuuauuuggauaaaacaauauuuauauaacaaaagaacuacaacucaggagcauauaguuugaggcauaugaguggucccaaaaggagccccaaugggccaggcacgguggcucacaccuguaaucccagcacuuuggaaggccaagauggguggauggcuugaggccaggaguuugagaccagccugggaaacauaacaaggccccauauauacuuuuaaaaaaauuagcuggaaguaguggugcacaccuguggcccagcuucuugggaggcugagaugggaggaucgauugagcccuaaagauugaggcugcagugagccacaaucgugccauugcacuccaaucuggguaacagagugaaaugaaacccugucucaaaacaaaacaaaaaguaccaaagggaauauaaaaggcaggcaaaagaauguccagcuaaagugaucagguauauccuccugucccaucugagaugaacagguuuugugcugguuauucuccaucuggcuccuguccugguuuucugugacugccguaacaaauuacuacaaacuggauagguuaaaacaacagaauuuuauuuucucacaguuccggaggacagaagucugaaaucaaguguuggcaaggccacacuccugaaagcucugggggagaaucuucuccuugcuucuuccagcgucugggggccccaggccuuccuuggcuuguggccacuccucugaggucacauugccuccuccuuuuaucucuuaaaguuucugcuucucucuuauaaggauacaugugauugcauuuagggccuaccacagugaucuaggauaagguccuccucucaggauaagguccuccugaacuuaaucacauauuuugccauguaauguaauauucccagguuccagagauucggcugugggcauguuuuguuggcgggggagggggaggagaauaucauucaacccauuauagcccugauaugguuaggcuuuguguccccacccaaaucucaucuugaauuuuaauccccauaauccccacauguuuagggaaagaccagugggaggugauuggaucaugggggagguuccccccaugcuguucucgugauagugagugaguucucaugagaucugaugguuuuauaaggggcucuucccccuuugcuucuuacuuuucucucuccugacgccaugugaagaagguccuuguuuccccuuugccuucugccaugauuguaaguuuccugaggccuccccagccauguggaacggugagucaauuaaaccucuuuccuuuauaaauugcccagguuccaguaguaucuuuaaauuauagcagugugacaguggauuaauacaagccccauguccuucucugccacacucuguucccgacaaggauguuaccccacagauuucguccccugggagccagugcccucuggcuuacuguuggguuuguccaauggcaggcaucagcaaguaucagaggguaggaggcaaaagagguugagauauuucuucuccuuuccucccugcuuuagcgccauggguuuggcauuagguaugccccuucacaguucuagcucuuucuggacucugauaaacuguuucucuucaggccuggacuucuacugcuacucgaccuugggugccucaguauccgcuuaaguucccaccacccucccuacauccuuguaaauaucaauuucaucaaaugauuuucaaaaucccagcgcaaugugccuucaguuuugugccaugaucuugagugauagagauuccaagaagcaaaaauuuaauuuucagaacggagagauauacucagguuaccucagucuaagcuuaagacuaauacaagccccauguccuucucugccacacucuggcaacgaggagugggaaggugauucagcacacagugccgcccuagcaacuggguuaucuugugggcccuucaguagucaguaucuguugcuuugcacucuaauuaucugcuaguauugugacucuccacugcccuugcuguucaguacuuucuauucuuuucucaucucacagcuucuauugcugcaugcuuuuugcugccacaugaccucagcuuucuuccuucucucuguguaucuuuuaguuucugcccauuucuaacugcugacucucucuuuguauuucauauucaacucaacaaaagaaucugccuaguuuggcuguucaccaucaagugcaggugguuaggcagagccuucuuuuaaaaaaaaaaauuauuuuuuuaaaguagaaguaaaugggggucucacuguguugcccaggcuagucuugaacuccugggcucaggcaauccuuccaccucagccucccaaagugcugguauuacaggcauguccaucaugcccggcuaucaaagccuucuugacaaaccaucucaugagcauaggucugaugcccuagaucagguguccccaccccuggccuaaauggcuuuguuuggaauggcagaauaaauuguuacguaauuugguguccugucuauuagaaaccuagaaggggguuuauggguguggcagacaugaugacacuugcaggaaguggggaaggaugguuauuaaaaccuacaaguagccaggugugguggcucacgccuguggucccagcacuuugggagaccaaggcgggaggaucccuugaggccaggaguuugagaccagccuggccaacauagcgagaccucaucucuacaaaaaaugaaaaaacaaccccaaccgcaaauccuuaccaauggacuuuaauaagcuacaggaucuaguacccacuuguuucuuaucucuuacuaccaggaagcagcacagcauacuuuaguguuuaacagcaugcaucacuagagacagaccaccugaguuccaauccuagcucuaucacuugauugcugugucauuugggggcaguuauuuaacuuuccuguaccucaguuuccucaucuggaaaagguaaaaucaguaucuacuucauagacuugcugggagaauuaguuaauaucuuucaugugcuucaaauaaugcuacuaguaagggcuauuuaaguguuuguuagguaaauaaaauauuuccccccauucacuacauuccagccacauuggccucauugcugcaccuccagcaggccaagcacacuucugaccaagggccuuuuuguuuguuguucuucuaggggaacacaugaccaauuuccuuaccucuuucuauucuuugcccaaauauugucuuuuaaaugaugacaaugcuauuuaaaauugcaauucuuggccaggugcgguggguugcaccuguaauuccagcacuuugggaggccaaggcagguggauuacuugaggucaggaguucaagaccagccugaccaacauggugaaaccucaucucuacuaaaaauacaaaauuagccagauaugguggcaggugccuguaaucccagcuacuugggaggcugaggcaggagacucucuugaauccgggagguagagguugcagugagccgagaucgcaccauugcacuccaagccugggcaacaagagugaaauuccgucucaaacaguaaauaaauaaaaaugaaauugcaauccucuguacaacccugcuuuauuuuucucauuaucacuuaccuacuucuaauacucuauguaaauuugcaaauuuguuuuucaccuaucucucccaacuaaaggguaagcaagggcagggcuguuguuucauucucugauguaucccaggugccuagaacauugcauggaacauaaugggcacucaugcucuuuguggaaugaauuaacaagcuguauucagguaaacaaacuuggaaucuauuuugaagauugauuucuaaaugagcuuccuauggugcaugugcaaugccaaagaucuucccaaaaguuguucuuuuaaguugaauagagaugaucucccuuccacaauaucauuuauuuuaauaaacugauuagccaacugucuuuucuccccaaagauauuuaaagguaaacuuuagcugaaacuuaggucaacuucucuuuaauuccuaaugaacauacuuugaauuaaugagauagaccaacuccuaauuaauugcugguagacucuguagcacugcgauuuauccaacaugagcuaaaagcuauagcuuaucaucaggauauggaaagacaagaaguaauaacacugacucuaggucagauaaguugcuaggcuuaaaucugugaggcaaauaucaucaucaccaugguacagauaaacaaaccaaggccccaaaucacauaccuaauagguaauagagccaggaugcaaaccaucaguuuccaaaauccaugcuuuuccuuuuaucucauuuuauuuuauuuauuuauuuauuuauuuauuuauuuauuuauuuauuuauuugagacagagucucacucugucacccaggcuggaguucaguggcgugaucuuggcucacugcaaccuccgccucccagguucaagcaauuauccugccucagccuuccaaguagcugggauuacaggcaugugucaccacacccggcuaauuuuuguauuuuuaguagagaugggguuucaucauguuggccaggcuggucucgaacuccugaccucaggugauccacccgccucagccucccaaagugcugggauuaugggcauaggccacugcacccagcccaucccauauguuauuuuaagcuucaaauuucucauuugugauauguaguaagaguacuuauguacagaguugugacaauuaaaaauaauauauauauaaugcagaauacauauguaauauauauaacacagaauacagcuuucauuuauuauauauauauauauauauauaauacagcuuucuuuuauuuaacauauauaaugcagaaugcaguuuucauuauggcuguacuuaggaaugaugaugcgacuuuucccauggggaauaaucacagcugcuccaguuggaugacagcaauaaguucuacagaggugaguuaguuggaguagucacauuaaaaaaaaaaaagaaaaaaaagacauuuaaauuuaaaaaaaaaaguuugaaaauaggccaggcauggcagcucacaccuguaauaacggcacuuugggaggacaaggcgggaggauaucuugagaccaggaguucgagaccagucugggccacauagugagacccugccucuacaaaagaaauuuaaaaauuagccaggugugguggcgugcgccuuaaguccuagcuauucagggggccgaggugggaggauggcuugagcauaggaguuugaggcaguagugagcuaugaccaugacacugcacuccagccuggacaacagagccaggcccugucucuaaaauaagaauaauauagaguugaccuuacgaacccucacuagucaaauuugaggcaaguugaucaugaaaauguuguuuguaugguuguauaaaaaugauaguuuuuuuugcaaagcaaaagccaugcuuucaaagugauuuaaaaaguuggggaagggaagaaaggaggcgagaaugccagcuaauaaauguugagaaaaugaugaugcuuaagaaaaacacuguugugcaauccccaagggucaucuguagaugauaaagccauuaugugaaagguuaauggauauuagggcucgaaucauguccccccaaaaagauauguugaaguccuaaucccuagcaccccagaaugugcccuuauuuggaaacagcauuggggcacaaauaauuagucaagauacuggaguagggugggcuccuaauccaaucugacugcuguccuuauaagaagaccagggagaaccucaugugaagaucaaggcuggauugaggcguuguagcugcaagccaaggaaugccuagggcuaccagaggcuggaauaggcaaggauuuuccccugcagguuucagagggagcauggcccugccaacacauucuuuuccuacuuccagcuuccagacaauacauuucuguuuuuuaagccacccaauuugugaguacuuuguuaccauagcuccaggaaacuaauggggaacaggacugacacagugcaccaaagcaucaucccacauauauaaaagauagagcucuccaaacgagggauuuguuaguuaccacuuaaucaaguuucaagcuuaacagcacuaauagugggacaacccgacauuguauaucuccugauaugaugcaguaagagguacacaauaucacuuugauagacugauugcaauaggagguugaguuuauuucgcuaccacuuaccucugggcuggcuuugucacuugcuuuugccaacauaaugcaguugaagugacagagugccagcuguaaaccuaggccucaacagaggcuucuacacucuuucagacccugccuuuuccaugagaacaugccagggcuagcuugcuaagugugagaggcuaauggaacugagcccagccaucccagcugagaucaucccagacugaccagcuccuagucaacuuaccaaaugacuuggaugaaugaaucaguccagccaaaaucagcugagcccaguccagagcagcagaacuaccuagccaaugguucuuaauauuaugccacugaauuuugggauaguuuguuaugcaguaauagcuaaugguuauagucaucuauguuguaauuuuugcauuaguuuaaaugcaaacugaucaugaggaaacaaucagaaaaauguauagugagagacauucugcaaaacaacuggacuagaugcuacaaaagaguaagugccuggcagggcaccguggcucacaccuauguccaacacuuuggaagacugagguggaaggaucaccugaggccaggaauuccagaccagccugggcaacauggugagaccaucucuacaaaaaauaaaaaauuagcuggguguaguggugugcaccuguaguaccagcuacuccagaggcugaagcaagaggaucacuugagaccaggaguuugaggcugcagugaacuaugaucacgccacugcucucuagccugggcaauagagugagacccugucucuaaguucauuaauuaauaauaauaaaagucagugucaugaaaagcaaauaaaguagggaaaugguucuugauagucuagaacaggguuuuucaauuuagguauuaaaugacauuugggacuaggucauucuuuguuguagggggcuguccugugaauucaggcucuuuagcaggcaucccuggucucuagauacuagauaccaguagcacacccagucaugacaaucaaaaaugucuccaagcguugcuaaaagucugucuuggggcacuggacuagagaaacggaaucaaaugcaauguauggaccuuguuaauaucuuggaucaaaggcuauguaaaagacauuugguacgaaugaagaaaucugaaucugaacuuaaagauguuauuauugaaucacuguuaauuuucccaggccugaaaauggaacuguaguaauggaggaaaaugcccuuauucuuaggagauguaugcugaauuauuuuaagugaauaacuguaaaguauucaacuuacuuucuaaugcuucaacgguuaaaaauguauauuuacagaaagagauaaagcaaaagugaaaaaaguguuaauaauuggugaaucuaggugaagcauauaggcacauuccuuguacuauucuuccaucuuugugggucugaaaauuuucaaaauaaaaaauuggggaaagaacgaguuuauugcaucucuacugccuggcucuucauuaaucuaacgugauagaaggaggaggcuuguuuuaaaugaaucugagugcucauuuuguguugccugggaaaugagcuagcucaaaccagguguggagagcuagggcugaggaagggggcuucucucagccugagaaacuguacacaagcucaucuucccaagggaccacugucuuccuuucccuuguguaacauuccacaggaaccaaagucuagaugcugggcagcuugugugcguuucccagauaucucugguaaacagcugacaauaaauuccaggcugccuggugccaagauaaucugauuauuccuuucaugauaaggcugcucucacacuugcuacauacaaaaaagagacccaaagaaggacagaguucccuuccuuggaacgcaaaccaucucgugaggcuagcaggucacccagaggacgacgggaggaugggguccuugugccuucccuucucuuaaugacuuucccuuuguaaguuuucucuuuccacagaaaaaccuaauuucuuaaccucuaccgugugacaggggaauucaaaucaagcucuggugcauuaaaauggcaacugcaaagagaccuauuuugcaagagagcuaagguuuauuuuuuuuaauuuuaauuuuugcucuuauuuuuauuuuauuuuauuuuguaaagacagagugucacuauguugcccaggcuggucucaaacuccugggcucaagcaauccucccaccuuggucucucaaagugcugggauuaugggcaugagccaccaugcccagccaagagcuaacauuuaaaacacaggcagaacucagaaaccaaaaagauaaaugcugauaaacacauuguguaaaacauuuaaaaccuuuauaugguaagaauaaaaaugacaacaacaacaagaacacaccaugaauagagccaaagacaaaugacacaguagaaaaaguugcaauccaacagaaaaagugcuuauuucuuuauuuuacuaaaagaucuuacaguuuuaugagggaaaaaagaaaaaaaaaggcauaaagaauaggaacaaauauuucauacaaauagaguggcaaaaagccaggugugguaguucacgccuauaaucccaacacuuuggggccaaggugggaagaucacuugagcuuaggagucugauaccagccugggcaacacagcaagaccucgucucuacuaaaaauaaaauaaauuaacuggacaugguguuacuugccuguagugccagcuucaagggaggcugaggcaggagaacugcuugagcuugggagauggaggcugcagugaguaaugauuccacuacugcacuccagccuggguaacagagcaacguccuauccaaaaaaaaaaaaaaaggaaaaaacacuugaaaaaauacuuagcuucauuagugcuuagaaaaaugcaggucacaacagugugauaccauuuuuaccuaugagugacaaaaauuuuuaaauucaauaaaacuuaguuuuggcaaaguuacagugaaacuuacacugucgaugaauauaaaggaacaacuuuuuuggcgguuacaauuuaggaacauuaacccaaucuuaaauguacauauauuuugauccagcaauuucauugaaaggaauuuauccuacagagagucauacaaguccccaaugacauguguauaaggauauugauggaaauguuguuuauaauaauaguguaaguagaaaugauuuaaaguucaucaguuaggcaacaaauaaauuuauggcccauccaaugauuaaaacaucuacaugugcuauuauggaaauauuucugcuauauuacuaaaugaacaaagcaagguauaggaugauauauauuauuugcucuguguaaaaauggagucuauuuuauauaucuuaauauagaaaaaauacaccagaaauaauuaacagugcuugccuugugauaagagugggaacgagauuuuucccuuccauuuuaaaucaguuugaaguuucaauuuacaguugccccuugaagaacauggguuugaauugcauggguccacuuguaucuggauuuuuuaaaaccaaacucagauaaaaaaauacaguaguuggcucacaccuguaauccuaauuacucgggaagcuaaagugugaggauugcuugaugccaggaguuugagaccggcauaagcaacauagcaagaccccaucucuuuauuuucauuuuuauguauuuauuuauuuugagaugaagucucacucugucacccaggcuggaguguaguagcaugauuucagcucacugcagccucaaccucccaggaucaagcgauccuuccaccucagccucccaagaagcugggaccacagaugggugccaccaugcccagcuaauguuuuuguauuuuugguagagauggaguuucacuguguugcccaggcugaucuggaacucauggacucaagucauccaccugccucagccucccaaagugcugggauuacaggcaugagccacugcaccuggccaagaccucaucucuuaaaaagauauauauacaggcugggcgugguggcucacgccuguaaucccagcacuuugggaggccaaggagggcagaucacgaggagauugagaacaggagauugagaacagccuagcuaacacggugaaacccugucucuacuaaaaauauaaaaaauuagccacgugugguggcgugcgccuguaguucccgcuacuugggaggcugaggcaggagaaucgcuugaacccgggagguggaaguugcagugagccgagauagcgccacugcacuccagucuggugacagagcgagacuccgucucaaaaaacaaaauauauauauauauguguguguguauauauauacacaaauacucuguguguguguguguacauacacacacacacacagacaguauuugcagauacaaagcccaaauaucuugagggcugacuuuuuguaucugcccguucuguacggacaacugcaggccuugaguauguguagauuuuaguauauauaggggccuuagaaccacucccccgaagucuacugagggaugauacaauuuuuauuauggucauguauuacuuuuacaauggaaaaaaaugcacagauugugccuuggaacaacuuucaaaaugucaaucagugcuccuuaugauacuuuugaaauaggacaagguugugugcaggguaaauuguuuuuagcuggagaugcgaauaugcaaaugguacucauccauugcaacuagaagugugaauuuuagaaccuaggaagauuugaucagagcaguuaccaaguucauccuugaagcagcucagguucagccuuuagccagacuccuauuggaaagcccagcaagggaaaaauaauguaauaggaaauuuucuuucuccuucucuuucuuugccucuuuguggaauuucuucaggaacaugcaaguuaagauauacacaugacggccgggcgcgguggcucacgccuguaaucucaccacuuugggaggcugaggcggauggaucacgaggucaggagaucgagaccacggugaaaccccgucucuacuaaaaauacaaaaaauuagccgggcgcgguggcaggcgccuguagucccagauacucgggaggcugaggcagaagaauggcgugaacccaggagguggagcuugcagugagccgagaugacgccacugcacuccagccugggcgacagagcaagacucggucucagaaaaaaaaaaaagauaugcacaugacucagagguacugagauaugaaaaaaauuugccaaggugcuuggaugauucuuccucuuuacaaaugcaucauauuugugccuggcugguccucuuuaaagcacccaagguauuaaucugagaggacagccucuaucuggggaacauuuuuuuguucucagugaaguggcacauucaguuccuggugcaggcucacucaauuuccauuagucauuucacagcuguaucuugggaagagaaaauuucaaauacuuuuggcugauuucacaaguaaacaaaaaacaaggccuucccucuuuucucacagaucuuguuuguuuacaguuuucaagucaauaaaacacgccugucuuuguagauguuucuccuaaguguguuaguugucugcugaccuaucugccuggcuuccacucuacucuuguaccuagauuuguugcccucauguugcaggugaaugcuggacuacccacucuaguuuguuauuaaaucgauggagcaauuuuuguuugguaguuuaguauucuaaggcuguucauggacaccauuuagaaacgagggucaacuaucaagcgaaauacugaaucugaucauagguuuguuauuuuuucaguuguuuaagggcaucagauuagcacuuugggaggccgagguaggaggagcgcuucaugccaggaguuugagaccagcuugggcaacaacagcgagauucugucucuauuguuuauaaaauuaaaacuuuugaaagaggauauuagaugagugcacaaauuuguuauuauggggucacuaugaauacugaagaugcacacacagggaucauuauuguagggugguuugugacagcuggcccuguuuuaguuauuuccucaagaagacacuugaacaauuauugcaaugccuccucucuguaauuacaauaauaaucaugaugauuuugcaacugaauauucaauucaggguguauacacucaacuacuguuuuuagcuuguuucucuuuuuacauugaugucagcugcuguugucagaauugaacagagaaccauuuuucuggugaaggucaaugaacuacaugaaaaaaggaaucuggggccaauacaggaaauuauaagaaaaauaauuacaguuaggauuuaaggagugcuaacuaugagcuagauuuuuuucuccuuggagagagaaauauaauauuuucagcacuuaccugcuuuuaaaacuaauagaauaucucauuuaacccuuuucccauuuagaaaaaaaguguagcucgccgccagcacucauuuaauuuuacauaaacaugcucuuugaggcugaagcaaaucugacugauuuucaaugugaaaauaaaauauaaaaacuguucuuagaguuaauucuaaacagaacuaacaucagaaucaucugaaucaucagaauugucuauuucagagaaaugggauucaucaaaugaaucuuuggccaacuguucguuaacgauguuaacgucgcacauaggaaugcuauguuuucuaggauuugacauuuucagcaaucgagaauuacuguauuuuguaaauggaaauaccaccucuaaaaauagaaugcuauaaacagaaugaugucuuuuguuuccaaagucaauauacuagagcgaugugaaaauaauaauaaaagcaagauauuuuguggcaaaguuaucucgggguaaacucugcagccacaagcgcugcuggugaguauucuuggggcaaacgagaaaaggguuaauaauuauaacuaucugacaaugcuuuugcuucauauuauagucaauuaaggagcugggagugggaaagaugaugaagcagagaagagagguguguaauuguggguaagggggagagaauagagacuaaaggaaaauaagacacagaaggaauagugaggugcagaggcuaagaaagaaauacaagaaauaggugcaauaagaaugacaaugacgagguuggagagcaggugaaggagauggcaggcaggaagggagaggaaggggaagagaaaaauggcuggagaguggggagagagacaaguuuggagggugggaaaaaaaagcauuuguguuuguuuuuaagaucaauguggggcugggggugguggcuuaugccuguaaucccagcacuuuuggaggccgaggcagguggaucacuugaggccaggaguucaagaccagccuggccaagauggcaaaacacugucucuaguuaaaaaaaaaaaaaaaaucgccaggugugguggggcacaccuguaauaaucccagcuacuccagaggcuaaggcaggagaaucgcuugaacuccagagaaagagauugcagugaguugagaucacgccacugcacuccagugugaggugacacagugagacccugucucaaaaaaaaaaaaacaaccaaaaagaaaaaaaaagaauguggaaucucuagagcguggcauucauaccaccaucaccuguugcugguucucucuuugaaauacugauuagccacuguucauaacucuguagguauucaaaucauuuuaauuguagaccugauggauacggugggaaggcagaaauggaaaucuuacaagguggauguuuaugcuggcugccauugcaguauuugguuucuucaugcuggcuuuucgggagaaauuccaaagggaggaggugagcucagcugucaguuacuagcagcuuccugccuuuucuuauccuaagacuuaacgugagaaagucucaaucuuggcuguacauagacaucuuuugaggaacguacaaaaauguugauaccuaugguagauaaaagaaaaguugaucccuaggccccaccccuaauauguaauugguuugggauguggggugaggauuuuuaaaaguuccccaugugaagccaagggagagaacugcugcucagaggcuucacuauaaauauguucaccagagaaucccauuauaacacugauuauuuugggggcuaugacaucagugaacuaaacauucaguuggaugaaacucagccaaaggccagagguucucgaccuuugugcuauacauguaguaacuggcauagcugugaauugcauguggagcugugggaagaaagagauccucuugaggcuuauuuggaacucugcaggaagaaaagaagucaucaacauaagaaaggucucuauuaaaaaauuauguucgagaaauacugaacuugauuuuaacauuaugagggcaucuagugucucuuggaaggcaaacgucaauuguccuuuucagacuaaucugaaaucaguccagggaaccuggagaaaugguuugcuucuuuucugcuuguuuguuauggucuauagcucaguucauuccuugucacguaggacagcccuguguuuucuugcccucugaccugcucuccaaacuuccagaauaugguucuuuucaggagugaaguuaucuaggauuugcuaucaccaggcucuccuaccucugucauuccccaguucucucuauugcaguaacacugaaacuuauuuaaccugcccaucaccugugcugauauuuucaaggggaagagguggagauagaagcuaucccaccagccccauccuuugaugccagguaacaugugcaauauuuccauuuagaguggccuuccggaaccaaaacucccaaucugggaagggauucugauaugacaacuuucaugugaaauaggaaaaguuuaauugacaaugccacaggggccaauaccuguaggaggaugggauucuuucuagaugauugugcuacagggauagcguucauuaggaagugugguauuuggccuguggccuuauggagauaauacuauuucuaucgccucuauuauauuuuacauuccaacccuuucugaaugcuccauguauauuaauucauuuagcaucugacuacuccauugugagcuccucaauaaccagguguacgcccagccccugacucaugggaggugaccuauagauguucacuaaauaaauggaugaaaguuuaaccaauccaaguggaagcagggggaaaaugaaaggaacuacuuccgucuccuucacaaagaccaggcugacgaucugacuuguggugaugggagaaaaguguggaagaucuugacuuaacauuucuaccuggagcgcugggguacucuuuuucugagccaauuucacucuucccaaaaggcuguuugguuccaaauacacuaggcaucaguguuaauugcuuuucugaaauaucauuuugucagcuucguuuagaugugguaauuugcaaagcaacccccagcaguugacaguucauccauagcugagugguguucagacauuuccugggauuccugcccgccuucuaugcagcuggcaguguuugccaaaccaggauaugugcucaaccgggauuaacuuggaaccaguagugcuuuguugugucugagauuuuuuaaaauucugaaagggugaaggccaaccauuaguccagaaaauaaaagugcaguaacuuauaauuuaagaauuagcaggugcuucaagaugaccuaguccacacuggguggaugaggaaauuaugguuugacagguucaaugagaaggucagcuggcuggucgcugagaggccaggucuacaaucuguaucguuugugugguaccaaacugugcgcuggggucucuagauuuaugcuuguguggauguguuucagcuacuguuucuuucugaagcucuuuuucccuggccagagacuuccugaaccuccuucauacauguuucaaggucacagcccagaccaaaguguuuacaaaaaaaacuaagcacuuauaaagaggaauuauugccagcuccugaacucccaaugccccagcuccaacuaagcucugcaaaccaaggaagggaugaaguggucuuuggaaccaggaguuucuugguuuggaugccaauaggaaaacggaugaauucugucugauuucugcagcaggcggaggcugcagcugcuguugcugccaccuccugggagaagacagaccuuagcuucauaccugaagccagccucaguguucaccugugucuugggcaaagggcccauuggggcaggacugaaauuacuuucuccuggaaaauaaaagggauauccccuuacucaacaaacagaacccugguauucuuugcuuuuuguuuguucguuuuggcaagguuaugcuugaagaaauaaucucaaacaaugacaaaguuguaaugaguuaauaccggaaccaugagagagcagaaauaagauugaggcagaaccauuuguuuuaggaaaguaucagagauuccaucucuuggacuucugaauccuggggugauguuaggaaugcacgcacuugagaauuguaugauauaaaggaugcaugaauuuggugagucucaaccucuaagagucucaguuuacuuguggggcuguuaugaaaauuaauugagauaaugcauguaacuuccucauaugagaaguguucaaugugaauuauuuugaggcaaguucacucuuauauccccauugugauuuucuauauuuacggaccaaaaaaacuggccaacagccccaugccuuuaauucuuucuagucuucugauuuauagaugaucccuaagcaaacuccuuuuauuuauuuaaacauaauaauacacuagugagaagaaauucaggaggaacuaggagauucaauuuaaaaaauauuucuugagugccuacuaugugcuguauguguacaauauagguauaggccucaaaaauguccccugaaguacauuaggaagaccaggcacagugacucaugccaguaauccuagcacuuuggaaggcugaggcgggaggaucucuugaggccaggaguuugagaccagccugggcaacauaggaagacccugacucuacaaaaaaauaaauuagcuggaggaaguggcccaugccuguaguccuagcuacucaggaggcugaagagauaggaucaccugagccuaggaauucaagguugcagugaguuaugaucaugccacugcuguacuccagucuuggcaacagagugagacucugucucuaaaaacaaaauaaaacaaaaaauuacauuuggaaagugguugagaauuggggacuuggguucuagauugagauguguaaacagccugguuguauaaaugaccuuaggcauggcagcuaacauauuuggauauuaguuucuucaucuguugcauaauaauaucauaaaaggaaaugcuuuuauuuacagcagagcuugccuaugggauagcgcauugaauucuguguugugcuucaacugcccuuuaacaguuagcacuguuaaagaaaacaugaauuuugagugauccugguaagcugaaggaaaacccuuauaggaccuaucugaagaauuuuuucccaugaaauauaggucuuguuuuaaccaaucacauagagagcuauggauuuacucuggccuauuuggaguguuuguuuuucauccuuugcugugguuugaauguuuguguccccuccaaaauugaucuugaaaaauucccaaugcaacagcguuaggaguugaggccuuuaggaggugguuagggaaugaugcucuguccucaugaaugggauuaguaaccuuauaaaagggcuggaaggagcuaggcaggcccccuuuuugcccuuccauccuuuccaccauaugaggacacagccauccguccccucuggaggaugcagcaacaaggcgucaucuuggaagcagggagacugggcccucaccagacacugaaccugcgggcgccuugauuguggacuuccaaccaccagaacugugagaaaugaaucucuauucuuuauguguuacccagucucaguuacuuuguuauagaagcaugaacagacucaaccuuaaauagcauagcaaccaugaaaccccuuccuaacaauuaaaaacacaugcuuuuugcccucagccaacugguguguuccuuugccugaaaaauaaacucagcuguguuuguuuugcuuuguuaacuuugguggccuuuaguaauauuauuauuugacaauuugaacaguacuauagaguuuacuuaguucccauauagcaacuuauuugggaagaaaugugaugcaauccaacaggaugggcuuuugaaccaaaaauauucugggucugucacugauuagcucuauuuccuuggauaagucauuguaucagucaaggucccagucucugccuagaauucuuucuguucaggcuuugugggggugacucuucaucacuguacuaguuuaaguauuaccuucuuagagaagcuuucuuuaccauccaaucuaaaaauuacccugguuuagucucuacauagcacagacuaaaauuaucugguggacuuauuuguuauauuuuauuuugccccaccagaauauuagcuguaugaaguagggcgcuuguauggccugucugcuuaccccuggcacaucacagccuuuccauaaauauauguugcaaggaaaagagaguggauagcgacaaaccaaacacaaugaguuauucucucucucagggaaauauuuaauauggagacgcauacugaaaggcauuggagagugauaugguuuggcucuguguccccacccagaucucaucucaaauuauaauccccacgugucagggaaaggaccuggugggagguaacuggaucaugaggguggauuuccccuauucuguucacaugauagugaguucucaggagagcugaugguuuaaaaguguggcacauccccccuugcucucucccuccugccaccuugugaagaaggugcuugcuucuccuucaccuuccaccaugauuacguuuccugaggccuccccagccaugugaaacugugagucaauuaaaccuccuuucuucauaaauuacucagucucagguaguucuuuauagcagugugagaauggaguaauacagauaauugguaccaggaguggggcacugcuauaaagauaccuaaaaauguggaagugacuuuggaacuggauuaugggcaaagguuggaacgguuuggacggcucagaagaauacaggaagaugugggaaaauuuggaacuucugagagacuuguugaaugguuuugaccaaaaugcugauagugauauggaccaugaaguccaggcugagguggucucagauagagauaaggaacucacugggaacuggagcaaaagucacucuugcuaugcuuuagcaaacagacugguggcauuuugccccugcccuagagagcugugaagcuauaaaccugagaaagauuauuuaagguaucuagcagaagaaauuucuaagcagcaaagcacugaagaugugaucugacuguuuaugaaaguuuacagucauaugcauucacaaagagaugaucugaaauugcaacuuauguuuaaaaggaaagcagagcauaaaaguuuggaaaauuugcagccugaccauguggaagaauagaaaaacucaucuccuggggagaaauucaagcugccagcugcaaaaauuggguaaguaaagaagaaccaaauguuaauugccaagacaaugcagaaaaugucuccagggcaauucagagaccuucauggcagccccucccaucacaggcccagaggccuaggagggaaaaaugguuucaugggcugguaccagggccccacuacucugcaggcuugggacauggcacccugcaucccagccacaguugggggaugcaggaugccaugcccauuuuagccacaacuacagcuccaguuguggcuaaaaggggccaagguacagcuugggcuguugcuccagagugugcugccccauaucuugguggcuucuaugugguauugggccuguaggugugcagaaggcaacaguuaaaguuugagaauccuccgccuagauuucagaggauguguggaaacaccuggauauccaggcagaagucugcugcagggguagugcccucauggaaaaccucuacuagggcagugcagaggggaaauguggaaugcgagcucccacauggaguccccacuggggcacugccuaguggaccugugagaagaggacaaccauccuccaggccccagaauggcagauccaccaagagguuguacugugcaccuggaaaagcugcaggaacucaagggcagcccaugaaagcagcugcaggggcuguaccccgcagagucacaggagcggaguuaccuaaggccuugggagccuaccucuugcaucagcaugcucuggaugugagacauggagucaaaggagauuauuuuggagcuugaagauuuaaugacugccaaguuucagacuggcaguggggccuguaaccccucuguuuuggccaguuucuccauuuggaauggaagcauuuacccaauaccugaaccccuauuguaucuuggaaguaacuaacuuguuuuuuuauuuuacaggcuccuaggcagaagggacuuaccuugucucagaagagacuuuggacugugaccuuuugaguuaaugcuggaauaggacuuucgguggcuguugaggaggaauaauuguauuuugcaaucugaaaaggacaugaaauuggggaggggccaggggcagaaugauaugguuuggcccugugcccccacccaaaucuuuucucaaguuguaauccccaugagucaagggagggaccugcugggaggugaauggaucauaggggcagauuucccccaugcucuucucaugaugugagugaauucucaugagaucugaugguuuaaguguuugagacuucccucacuggaucucucucuccuccugccuugugaaaaagguacuugcuucuccuuugccuucuaucaugauuguaaguuuucugaggccuccccagccauauggaacugugagucaauuacaccucuuuucuucuuaaauuacccagucucacguaguuuuuuuuuuuuuuuuuugagaugguaucuugcucugucagccaggcuggaaugcaauggcaugauuuuggcucacugcaaccuccaccucccagguucaagugauucuccucucucagccucccaaguggcugggauuacaggcaugcaucacuacgcccagcuaauuucuguauuuuugguagagacaggguuucaccauguuggucaggcuggucuugaauccugaccucaggugauccaccugccuuggccucccaaagugcugggauuacaggcaugggcuaccgcgccuggccucagguagguuuuuuuuguuuuguuuuuucuuuuuuuuuuuugagacagaguuucacuccuuuugcccaggcuguagugcaauggcaugaucucagcucaccgcaacguccaucucccagguucaagugauucuccugccucagccuccugaguagcugggauuauaggcaugugccaccacgccuggcuaauuuuguauuuuuaguagagacaggguuucuccauguuagucaagcuggcugccaacucccaaccucaggugauccacccaccuuggccucccaaagugcugggauuacaggcgugagccaccaugcccaaccuagguaguuccuuauagcaaugugagaauggacgaauacagauuuuacucucuguaaagaugguagcuugugggggaugauaagacaacugggucacuagagcuggugugucaccauagcugcuguuaugccuaaaaaaaugaugauccauuguccaguuuucuauaagguucaauaugucucaaucuucgaauugcaagggaacuagacagauuauaauuuccaggcuuucccuguguaucuuacaauaaaccccaucacuuaaaaucauguccuguagacaaaggagaguuaagauguaccgaggaguucugagggucuaacuacuaggagccuccugcagauuuugaaauuucucuugucuucuauuuuaucuuaccauuguugaccuaaaaggaagaagcugaggcaaaauuaauauaaguagagaguuuauuugggacaagcuugaggauugcaacuuaguaacauagauucuaguugccgugaauauacauucugaguagcagcaguuacaaguggauuuuuuuuuuuggaggcaguuucacucuugucacccaugcuggagugcaauggugugaucuuggcucacugcaaccuccgccuccuggguucaagacauucuugaagucuugagucugccucagacucccaaguagcugggauuacaggcacccaccaucacagcuggcuaauuguuguauuuuuaguagagacaggguuucgccacauugguuaagcuggucucgaacuccugacaucaggugauccacccaccucagccucccaaagugcugggauuacaggugugaaccaccacacucagccacaaguggauuuuuuuuuuuuuuuuuuuuuugagacagggccucgcacuguugcccgggcuggagugcaguggugccaugucagcucacugcaagcucugcuuccuggguucacgccuuucuccugccucagccucccgaguagcugggacuacaggugcccgccaccacgcccggcuaauuuuuuguauuuuuaguagagacaggguuucacuguguuauccaggauggucuugaucuccucaccuugugauccgcccaccuuggccucccaaaaugcugggauuacaggcgugagccaccacgcccggcccacaaguggguuuuuaaaaggaaagaagaggcaguuccugaguuauuuaccaauaauuuacauuaacauaacauaagcuguugauuggcuauccauuauuaagcuauaggauauggguuauaaugucuggugcagcaccaguaggcuaauuuucagcuacuuguggcaauaguaagcaguauaaaaagaugaguacaugccucaaaaggggguguguguaggacaggauugccgucucauuuuaauaccucucuggaucugauaauuggaaaggacuugcauucuucagauaaaaguucuuuuucucauuucuuccuuuugaucaaaaaucuuuccuuuugaaagcacugaugaucaaaaucugagugucaagguaucccucauugccagaaaggcucaugcccagguaguccuaccagucauugauuuauagcugccaucacuuguggaaucaccucuucaguguaccaugaauuuaguuuucucagaagaaauaaaacaaugagagauacacagcggaaauauuuugagguucccaggccugucagaaagugacauucuuuacuuaacacaggacagaaaucuugaaagggaacuacguagacaagggaccaggccagucuuuccaagaggcuuucuaauugccucuauagagucaaccuccauucuucaaagcagucuggucauaucugaaaauaugucauuccagucaaauccuuaguaaaauaacaagugucuccaauuauauccuguuacagaaaaaagauucuuauuaaauguaugcaaauaacuagauugccauaaaauaagaguacucaugaauaguuuccaaauuuuggaguaaucagguagagagaaaggcagauguuucaauguuguucacaaagguauuuuuacccaauuguuauaaaguauaaauaaauagcucaaggaaaaaaaguuuucuugacucuggaagacaaaauaaaaaaaaaaaccagcaauguuuuaaauaaaaagucagcaaaucuuuucagucuucugucaguucagucacauguaauuaauucguguucugcuugauguugaguuagcaaucuaaggaacacaucaguuuauuacauaccugaaaguuguuacuuaguccaaugauaugaucuccaaaguuaucagaaaccuguauucaagaguacuugucaggguccuauucuaugaauuuccuugaagaaaaagcaaauuuugaauuauagacaauuguaacugcuuuaugagaagagaaauaaaacuaauuguuuuagauagcaaaagacuuagaauagccaugguuaaagaugcaauugacaaggaaauuugguuauuccugugguuuacaacaguuuaacauaauaaucauaauuaugacugauaacauauaccaagacacauuaaaauuuuaggaaucucauacaaaacacauucauccuaauauaacucaaagaaaguuaaacaccauuauuucuuugacaaugcuuuccauaugauuuuaacaugcuaaauaugccuaauauuccucucuuggacuuccagagguuccuuuuggaaaauacuuaauuuuagaauuugaaauuugauuuuaggaaguauguccaauuuaaaaguuuaaaauauuugaccaaauaggaucauaagucacuguaaaauaguauucauucauuuagccaaagugauaauucaaagauugcaaaaagcaaaacccuuuacucuuugauagagaguaaacucgguuuuccaaacaauccaaagaccuuauaaagacggcaugagaccaacagaaucucucuuucccauuuuuuuuuuuuacuuaaaaggugaacuuuuuuuuacuguuucuuaaaaauacuuaaaaaucuuauucaaaagagaaaaccaaauuuuacuuuugcaucaguauauuauuaauccuaaggcuaauuucauuaaauccuuauaaacaaaucuaucaaaucucaggcagguauuuuuuuuuguuuuuuguuuguuuguuuguuuguuuguuuuagauggagucucacucuuguuacccaggcuggagugcaaugaccugaucucagcucacugcaaccucugccucccggguucaagugauucuccugccucagccucccaaguagcugggauuacaggcaccuaucaccauacccagcuaauuuuuguauuuuuaguagagaugguguuucaccauguuggccaggcuggucucaaacuccugaccucaggugaucugcccaccucacccuuccaaagugcugggauuacaggugugagccaccgcaucuagcccucaguuuuaacugcauaaaauuucuauaaccuuuaaaaauuuuucuauuaaagagcagauuaaugcuccaagaaagcccuguuauucugaaacaggggucccacaucagugugcuuuaaauaucaaugcauaauuuuuagaaaaguuaauaaucuccuucuaauuuuagccaacuuuaucacauacaaaauucuuuucaugagauuaaucuuauacaaaccuuuuacaacuugcuuacaccuucaguuuuguccuauacuucauuuuucuuauauugguauucuacuuaggacaaagauuuacuaucccccuuaucauuuugaccaaaguccccucuuacguaaaggaaaaaaauuacccuuuucaacuuucuuuacaucuucuuuauaugcucucuauguaaauuucuggccuaguaguuuuaguuacauauauuaaccacaauguuaacucuuaguaacccuaauuuucagugaaaaaccuaagaaguaagcaacuuuauguaccguaugcagagcucaggacaaaugacagugcuauggagacaaugccuggaggauccaacuccuugcaguaaagccaagaggcacagcucaacuagggaugauggggcccaggcacuguccccagggccacuugucuaguccucagaaucuaaaggcucaaauccaaagacauaagcucauagacaaauuaagcaaauaccaaaaaauaccauaaaagcaauggccuuaugaccuuaagacauuuagcagagacaguauaaaccagucuaaccaauagaucuaggcaaacaugucuaaauuaaaauuugaagacguuucuauuuuacuuuaccaauaauuuaaaaacuaucuuaauuuaaacccaagauuacuaaagucaagugaccauggaaagcauuuggguugguuauauuauuuaugagcacguuuucuauaagucagugguaccauguagacaauauauaaacagacauguauacaugguacacauaaaucagacagacacagauaaugacuucauagcuuuaauuaaaaaauuuuagccacauugaaacugcuggugaacugagguaagaaaaacaaaacaaaaccaagcagagaaaaaaauuuuagucaugagacugguaaaacucacuaguuuuacaaggacaguuggauucaaacuguaccuuuguaaauggaaaaguuuaaaguuuaucuguuccacauggcugaagcucguacugaguuuuagagaaaaugcaguaguaacuuuauaucucaaaguacaaggagaaagaauuuaagccuuuucaaggaggaguuuggguguguuggaagaaaauuaaaaauggaugccaagguaauacaaaaucacaggaaucuaucauuggauuuuauaaggagaccuauuucacuuagauaaguagcuuuuaauuuagucuguuuuccaguuggaucacugagcucagggcagagcccauuaaggagcagggccaucaaagcauuuacaguuuuuagagccuaauaauuuaaauaugugaaaagcagaugcaauugaaggcagagcaucuagagcuuuauaaauuaaggauuccauuuuuaggcugaauccuggguccccaaaaagagggaaacuccaugggacugggcuaugcaacacuuucaugguguacuucaauacaaaaacauuucucuaaguauuuaaaccgugccuuucuuaucuuaaccagcaaagaaaccaguaacucccuguaguaauaauaauaaccauucacuguaaacaacugcugucagccaccuccaguaacuugccagccaucacauacacaaagguuaaguguucucucacagaacaaaguaauauccaguacuccuaaaagucaaagggaucaggcgacacgauacaaaagagagcagaguuuugugcuggaaacugucaugaaaucucuccaugacucuucacacuccacaggaagacagaagaccccagaaagggagugagaggcagcuuuuucugucuuccuuuaggggucugagucauuagaagucuccucuagaucuuuucaugugguacugaagacagcagagagaugggaggagguugaaucucauuuuuguuuguuuguuuuugagauggagucucgcucugucacccaggcuggaaugcagugguacgaucucggcucacugcaagcuccgcgucccagguucacaccauucuccugccucagccucccgaguagcugggacuacaggcaccugccaccacgccuagcuaauuuuuuguauuuuuaguagagacgggguuucaccguauuagccaggacagugucgaucuccugaccucgugaucugcuugccuuggccacccaaagugcugggauuacaggcuugagccaccgcgcccagcccuuguuuguuguuuugagagagagggucucucuguucugcgguacugaaagaaaaauaaaaaaauagaaacaggguguugcucugucacacaagcgggagugcggugugacaugauuacaguucaucuagccuugacacauucugggcuuaaaugauccucgaccucagcuuccuaagcagcugggacuacaggcacacaccaccaugccaagauaaguuuugcuuuuacuuuuuguagagacagggacucauuacauugaccaggccggacucaagcaauccucccacuguggccucccgaagugggcugggauuacagacaucagccaccaugccugcgugaaucuguuuuuaaugaagcuggcuuuugacuauggaguucuuaaacacuuuucgagaaggggccaagauggccgaauagaaacagcuccagucugcagcucccagcgagaccaaugcagaaggcaggugauuucuucauuuccaacuaagguacccaguucauuccauugggacugguuagacagugggugcaacccauggagagcaagcagaaggguggggcauugcuucaccacggaagugcaaggagcugggggaccucccuccccuagccaagggaagccgugagggacugugcuacccagccuggauacuaugcuuuucccacgguauuugcaagccggagaucaggagaguccuucgugagccuacaccaccagggcccuggguuucaagcacaaaaccaggaggcuguuugggcaggcacugagcuagcuacaguuuuuucauaccccaguggcgccuggaaccccagugagacagaacuguucacuccccuggaaaggaggcugaagccagggagucaaguggucuugcuaagugggucccacucccacggagcccagaaagcuaagaaccacuggcuugaaauucucacugccagcacaccagucugaagucaaccugggacaauugagcuugguggggggaggggcaucugccauuacugaggcuuuaguaggcaguuuuccccugauagugauaaggagacugggagguuuggacugggcagaauucaccacaguguggcaaagcggcuguggccagacugcuucucuagauuccuccucacugggcagggcaucucugaagcaaagguaacagccccagucaggggcuuacagauaaaacucucaccucccugggacagagcacuggauuguccccagagcacugcggaggggcugcugugggcacagcuucagcagccuuaaucuuuccugccugcuggcucugaagagagcagcugauccugacaaaggguauucucccaacacaggguaccagcucugcaaagggaugaagugccuccuuaagugggucccugacccccaugccuccugacugggagaaaccucccaacagggcuugacagaaaccucccaacagggguugacagacaccucauauaggagagcuccggcuggcaucaggcuggugccccucugggacaaagcuuacagaggaaggagcaggcagcaaucuuugcuguucugcaaccuccacuggugauacccaggcaaauagggucuagagaggauguuuagcaaacugcagcagacuugcagaagaggggccugacuguuagaagaaaaacuaacaaacagaaagcaacaacaacaucaucaacaaaaaagacucccacacaaaaacucccauccaaaugucaucagccucaaauaucaaagguagauaaauccacgaagaugaggaaaagccagcacaaaaacacugaaaauuccaaaaaccagaaugccuccucuccuccaaaugaucgcaacuccucuccagcaaggacacaaaacuggacaaauaaugagauuaacgaauugacagaaguaggcuucagaagguagguaauaacaaacuccuuugagcuaaaggaacauguucuaacccaaugcaaggaagcuaagaaccuugauaaaagguuacaggaacugcuaacuagaauaaccaguuuagagaggaacauaaaugaccugauggagcugaaaaacacagcacaagaacuuccugaagcauacacaaguaucaauagcugaaacaaucaaguggaagaaaggauaucagagauugaagaucaccuugcugaaauaaggugugaagacaagauuagagaaaaaagaaugaaaaggaaugaacaaagccuccaagaaauauggggcuaugugaaaagacuaaaccuacgauugauugguguaucugaaagugauggggagaauggaaccaaguuggaaaacacacuucaggauauuauccagaacuuccccaaccuagcaagacagaccaacauucaaauucaggaaauacagagaacaccacuaagauauuccuugagaagaucaaccccaagacacauaaucaucagauucccaaacauugaaacgaaggaaaaaauguuaagggcagacacagagaaaguucagguaaccuacaaagggaagcccgucagacuaacagcagaucucucugcagaaacccuacaagccagaagagagugagggccaauauucaacauucuuaaagaaaagaauuuucaacccagaauuucauacccaaccaaacuaagcuucuuaagcaaaggagaaauaaaauccuucccaaacaggcaaaugcugagggauuuugucaccaccaggcuggucuuacaaaagcuccugaaggaagcacuaaauauggaaaggaaaaaccaguaccagccacugcaaaaacauaccaaaauauaaagaccagugacacuaugaagaaacugcaucaacuaauguguaaaauaaccagcuagcaucaugaugacaggaucaaauucacauauaauaauauuaacauuaaauguaaauaggcugaacgcccuaauuaaaagacacagacuggcaaauuggauagagucaagacccaucagugugcuguauuuaggagacccaucucacaugcaaagacauacauaggcucaaaauaaagggacgagcaaauggaaagcaaaaaaaaaaaaaaaaaaaaagcagggguugcaauccuagucucugauaaaacaaacuuuaaacccaaaaaguucaaaaaagacaagggcauuacagaaugguaaagggaucaaugcaacuaacaauaguuagagaagagcuaacuauccuaaauauauaugcacccaauacaggagcacccagauucauaaaacaaguucuuagagaccuauaaagagacuuagacucccacacaauaauagugggagacuuuaacaccacacugucaauauuagacagaucaacaagacagaacauuaacaaagauauucaggacuuguacucagcucuggaucaaguggacuuaauagauaucuauagaacucuccaccccagaucaacagaauauacauucuucucaguaccucauggcaguuauucuaaaauugaccacauaauaggaaguaaaacacuccuuagcaaaugcaaaagaauggaaaucauaacagucucucagaccacagugcaauuaaauuagaacucaggauuaagaaacucacucaaaacugcacaauuacauggaaauugaacaaccugcuccugaaugacuccuggauaaauaucgaaauuaaggcagauaaagaaguucuucgaaaccaaugagaacaaaaagacaauguaccagaaucucugggacacagcuaaagcaguguuaagauggaaauuuauagcacugaaugcccauaucagaaagcuggaaagaucugaaaucgucacccuaacaucacaauuaaaagaacuagagaagcaagagcaaacaaauucaaaagcuagcagaagacaagaaauaacuaagaucaaagcagaacugaaggagauagagacacaaaaaacccuucaaaaaaucaaugaauccagagguaguuuuuuuaaaaaauuaacaaaauagaccacuagcuagacuaacaaagaagagacaagaaucaaauagacacaauaaaaaaugauaaaggggauaucaccacugaucccacagaaauacaaacuaccaucagagaauacuauaaacaccucuaugcaaauaaacuagaagaucuagaagaaauggauaaauuccuggacacauacacccucccaagacuaaaccaggaagaagucgaaucccugaauagaccaauaacaggcucugaaauugaggcaguaguuaauagccuaccaaccaaaaaaagcccaggaccagagagacugacagccgaauucuaccagagguacaaagaggagcugguaccauuccuucugaaacuauuccaaacaacagaaaaagagggacuccucccuaacucauuuuaugaggccagcguccuccugauaccaaaaccuggcaaagacacaacaaaaaaagaaaauuucaggccaauaucccugaugaacaucgaugugaaaauccucaauaaaauauuggcaaaccgaauccagcagcacaucaaaaagcuuauccaccacaaucaaguuggcuucaucauuggggugcaaggcugguucaacauaugcaaaucaacaaacguaaucuaucacguaaacagaaccaaugacaaaaaccacgauuaucucaauagauacagaaaaggccuucgaugaaauucaacaucucuucauguuaaaaacucucaauaaacuagguauugauagaacauaucucaaaauauuaagagcuauuuaugacaaacccauagccaagaucauacugaaugggcaaaagcuggaggcauucccuuugaaaacuggcacaagacaaggaugcccucucucaccacuccuauucaacauaguauuggaaguucuggcccagggcacucaggcaagagaaagaaauaaaggguauucaaauagaaagagaggaagucaacuugucucuguuugcagacgacaugauuauauauuuagaaaacccauugucugagccccaaaaucuccuuaagcugacaggcaacuucagcaaagucucaggaucaaaaaucgcaagcauuccuguacaccaaucauagagaacagagagccaaaucacgagugaacucccauucacaauugcuacaaagagaauaaaauaccuaggaauacaguuuucaagggacgugaaggaucuuuucaaggagaacuacaaaccacugcucaaggaaaugagaggacucaaacaaauggaaaaaaauuccaugcucauggauaggaagaaucaauaucaugaaaauggccauacugcccaaaguaauuuauagauucaaugcuacucccauuaagcuaccauugaguuucuuugcagaauuauaaaaaacuacuuuaaauuuaauauggaaccaagaaagagccugcauagccaagacaaucauaagcaaaaauaacaaaguuggaggcagcacgcuaccugaccucaaacuauacugcaaggcuacaguaaccaaaacagcaugauacugguaccaaaacagauacauagaccaauggaacagaacagagaccucagaaauaacaccacacaucuacaaccaucugaucuuugacaaaccugacaaaaacaagcaauggggaaagaauucccuauuuaauaaauggugcugggaaaacuagcuagccauaugcagaaaacagaaacuggacccccuccuuacaccuuauacaaaaauuaacucaagauagauuaaagacuuaaauguaaaaccccaagccauaaaaacccuagaagaaaaccuaggcaauaccauucaggacauaggcaugggcaaagacuucaugacuaaaacaccaaaagcaauugcaacaaaagcaaaaauugacaaaugggaucuaauuaaacuaaagaguuucugcacagcaaaagaaacuaucaccagagugaaaaggcaaccuacagaaugagagaaaaauuuugcaaucuacccaugugucaaaggucuaauauccagaaucuacaaggaacuuaaacaaauuuucaagaaaaaaaacaaacaaccccaacaaaaagugggcaaagaauaugaacagacacuuccagaagaagagauugauguggccaacaaacauaugaaaaauagcucaucaucaguggucauuagagaaaugcaacucaaaaccacagugagauacuaucuaauaccaguuagaauggcaauuauuaaaaagucaggaaacaacagaugcuggcaaugcuguggagaaacaggaaugcuuuuacacuuguuggugagaguguaaauuaauccaaccauuguggaagacaguguggugauuccucaagcaucuagaaccagaaacaccauuugacccagcaaucccauuacuggauauacaccaaaaggguuauaaaucauucugguauaaagacacaugcacauguguguuugccgcagcacuuuacaauagcaaagacuuggaaccaacccaaaugcccaucaaugacaagcuggaaaaagaaaauguggcacauaaacaccauggaauacuaugcagcuauaaaaaaagaguucauguccuuuccagggacauggaugacgcuggaagccaucauucucagcaaauuaacacaggaacagaaaaccaaacaccacauguucucacuaauaagugggagaugaacaaugagaauagauggacacaagaagaacauuaaacaccggggccagucgggguggggccaagggaagggagaacauuaggacaaauaccuaaugcacguggggcuuaaaaccuagaugacaguugguaaguguagcacaccaccauggcacaaguauaucuauguaacaaaccuguacauucugcacauguaucgcagaauuuaaaguaaaauuuaaaaaaaauaaaaacuuuucaaaucucucauuaucaaguauuagccagcacaaauagcuguuauuccuggcuuuugaacuuuaaaaaacaaacaaacaaacaaaaaacaaagguacccuuccaaaugacucaccaaaaccaauaagccuuuaucaagguuaugacuuaaccaaggaugcauggggcaucuccaaaggaggugcaacacaguccucacaagaucaagaaucaucccaaagacagcucaaagaaagggaaguuucacuagccacaaguaaaguacaacucacauuucuaucugaucucagcuucucagcugguuacucaugaaggcccaaauggucuguaugucccacaaauggaaaaagacaggaaaucaaaaguuguccauggaagagauaaggaucaauaacaauugguaucccaaaagguuaagaaucauacaauacuuuaaaacaaaugagauuagcucccuggcuaggaauugaacucaggcuacaguggugaaagcaccaaauccuagccauuauaccacuggaugggguguuuucuuuguuuuuguuuucauuuuuuuguuuguguguuuguuuuuugguaaauuuugcagggaauccaaagcaggcaguuuaagcauuuaaggauuuuaucuugucuuagaucugaucucaucuggaaugcugcuuagcuaauucccugaauguuagcauuuuaaagacaugauaagauuuaaaggguacugucucacagugggucaauaaaucaguguguauuaguucauucucacacugcuauaaagaacuaccugagaccggauaauuuauaaauaaaauugguuuaauugacucacaguucuacauggcuggggaggccucaggaaacuuaaaaucaggguggaaggugaaggagaagcaagcaccuucuucacaaggcaguaggagagagaaagccagaaagggaacugccaaacacuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccacugccaaacacuuuuaaaccaucacaucucguaagaacucccucccuaucaugaaaacagcaugggggaaacugccuccaugauccaaucaucucccaccaggcuucucccccgacacguggggauuacaauucgagaugacauuuuguugggaacacagagccagaccauaucacagugucauucacuagaccuggugagaaaaaauuuuguuggaucugcauuuuuauagucucagcagucuuauucccauucuguuguuguucugcuuguuccuucugcucuaaauuuaaauucauuuccccugagagaaggaaauguguacauugugaaauuuuaaaacaucucugccuaagagauguauggaagccaagagaagcggcagaaagggaugaguucagaucacagggcuggaaggaaaaggagggucuggaggugaaagggagaaagccucugaagucuuuuaacauaguuucaaauaucccuuuguuuaccucuugaaugaaggugacuuuuucuuucaggauuucuuuuagaaguuuuuaggugccaguggaagucagucucuuauuuacaugucugguucuaaaaccagcucuuuccaauggugugcacaaauaaauuacuuuagguauaucaaaagauccccauuuuuggucauuguugccuaugaucauuccagguuagaugggucuacuuucccagauacuacaagacaguaccccauaaaucauauauguaguuccagcagguauuucuaaaaagaguguucagguuuugaacacucuuauuauugauuucucauaacucaggaacuuuucaaaagugaccaaagccaggaauguguuuaggaucaaaguguggcauguuuuggacugucucuaauugucagauggcagcagaguccucaaggaugaggacaauuggauugucuguaauugucagauggcagcggaguccucaagguaugggggaccagacccucguauuacguccaccuggaagagcaaaagggguacacauuucaguuaggaacuaacaggaauuaguuaaaauuaaagacuaauucagaauuuucaagugauaguaaacaacugcuaucucaaacacauacgauauaaaaugaaaccacuggugccuaacugccaguucuuucacucaaaccucugcugugagacagaggugaaaaaaacuugacccaaaccccugguucugaggcagaggcagaaaaaccaugaccugcaccucugcuguaagacagagagggaaaaaaggcaguucccugcagagcucuauacccgaaucuucuguccaaagacagagaccgaagcccucacacuuaaagaaaggguuugaaaaacagcccaaauaaagucuagaccuucaacccaagaguaggagguccaaauuccggagaacucaucugaaacaccugaugagacuucugaaggaagagaguucacacugguaccaagcgcugcuuucagagagaaacaccaccagcugguuggggggagucacugugaauccugcugacuuacuccagauguuuuaccuaaaaggaagaagcggaggcaaaauuaauauaaguugggaguuuauuugggccaagcuugaugacugcaaccugggaacauagauucagguugccuugaauauacacucugaguagcagcaguuacaaguggauuuuuaaagggaaagaugaggcagugccugaguuauuuaccaagaauuuacauuaaaauaaaucaagcuacugauuggcuauacauuaugaaacuauaggaugaggguuauaaugucuggugcagcauuaauuaguagguuaauguuuagcuucuguggcaauaguaagcaguuucaagagacaaauacacaguucaaaagugggggagaaggacaggauugcuguuucacuuuaaugccucucugggccucauaauuuaaaaggauuugcauuccucagauaaaguucuuuucuuaacauuuaaacaaauuuucgucuugguaucauaauauagcugucuguauguuaacauaggaaugcuuuaaauuauuuuaccauuuauaaaauuugugaugcaggaaagccaugcuauccugggucuuuaccuucugaguagcaauuauaccucagggauacacguuuguagucugagaagugcuggcauuuuuuuuuuccuuugcaacucagaagucucuaauuaaaguucucuuuuagcauuauucauucacucuuugauaaauauuuacugaacaucuuuauuugcuagacacaucaacaggacugaggauacaacugugaacaagauauguaugacucuuaucuucaugggagcuaucauuuagagagaaagaaaggggaaaaaagagaaaauuaaaauauauugugaugugugcuaagauaaagagggaaacuuagagugcuaagagaaauguaaaaaauguuaccuauccuguguuagcuugcauaggaaaaaaaaaaugaagaaaacugucaccuaaucccagagcagguguugaagaaagauuuucggccagacgcaguggcucauaccuguaaucccagcacuuugggaggccaggccgaggcaggaggaucgcuugagcccaggaguucaagaccagccugggcaacagagugaaacccugugucuacaaaaaaauuuaaaaaguagcuugguguggugaugucugccuguggucccaccuacaugggaggcugaggcagcaugauccuuuaaacccaggaggucaaggcugcagugagucauguucaugugacugcacuccauccugggugacagagucagagugagauucugucucaaaaaaaaaaaaccaaaaaaauuuccaggaccaaacagucuacaggaugagcuggaguuagccagguaaagaaugggaaagaauauuccaugccuggcuuagagcaagcuccggaggcuagagagaacaaggacucuaugggaacaaauucagugugcuaguuagugggcagaugucaaaagcgcaaaggagaaaaguggggggggggugguggugaggaagcuggagagaaaaaucaaggcagguuaugaagggccucuguuaaacaguuuagaaggguauugaaagucaccaaaaggauuuaagcuuaagaagaacuaauuaacauguguuuuuaaaaaagauugcucaggaacuaugucuggaaaagaacaaggacuugacuuacauuaagguaagaaguggaauuauaaaaucuggggcccaaaggaauuggagugaguuaauuccuccccuuuaaagugucuauuuucuucaaagauaaccacuauaucaucucuggggcuaacauucucuggcccuuucccacugucucuggcagcucccgacccaagucacuacaguuacagcauucccuuaaggaacacaugcuuuuccaaccugcugcaacacagaaagcacauguaauuuuuuauuuuauuguauuuuauuuguuuuucugagacagaauuucacucuguugcccaggcuggagugcaguggugugaucuuggcucacugcaaccucugccuccuggguucaagugauucuugugccucggccucccaaguagcugagauuauagguguaugucaccacacgcagcuaacuuuuguauuuuuaguagagacgggguuucaccauguuggccacgcugguuucgaacuccugaccucaggugauccacccaccucagccucccaacgugcugggauuacaggugugagccaccgugccgggccuggccuuucuaucuggcuuuuuugauuugauauccuaguagagcccacuauuaaaauuuccaucuauagaaacaggaagucaggaaaggacuggagggaauuucggcagguuaaugauuacaacgggaagagaauacaauuauugagguguuuugacucacuuggucauuuccugagaaacucuuugcuugaauuuuuccacucuucaggugaagaugaugacacuguccaggcuuucaggaguccaaccucuuagacaauaagcgacauacucuuugguaacugcaguggcuaagccaaggaauaaauaugcauaacuacaacaaacagguacuugaugagaacguuaucuagagcugccagauaauuuagaccaagugcaccuuuuguuguaagaagcugguaugauguccacauaguuuucagggcugcuguucccucuaagaagaaggaauagucuuuuuccugaacuacucucucucugaacuuuuaggcuacaauuaugucaguucaaagugggcagauuugccaacugaaaaaaugaugacacgcagcuucccaacucuguaaggacuuuucaggucugugggugaacgucauucccgagcaaaccaaugccacaagauuaguaggaugcggcucacaagaaauguuuacaaugaagggcaucacagacugcaaaccaaacaggguaggaggacacgggaccauuuccuuuuccugucuccaucugacucuggaaggcggggacaagacauuuaaaaccaggaccacuccaggaggacagcacauuagcuacugcccuccagcucccuucaguguuguuuccguaaaggacuuauaaacuggcgagggcgguggcuuccaaaagcgcacaggcgucccuuuuccaacuuggucuucuuauuuucccuuccugcuccauaacuacaacguguuucuguucguaaucaucucggcuuuuccuuaccucugcuuguaagaaaaguccuuugcgccauuccccuccaagccccagggaagggccuggaaagcgcuuacaccucagacccagugucggucagccgucaaggagcgagcgacgugggaaacccugagauaggacauuggcccggcgcugggcucggguaacgaugcggggcggggagcgcgggcggccggggagggcggcggccccuuuaagagcaggccacgcccccuccccuccucccguucgcugccagcggucgguggcggccgcuacggugcugacaagauggcggcuggcggagcugucgcugcggcgcccgagugccggcuucuccccuacgcgcuacacaaguggagcuccuuuuccuccaccuaccuucccgaguaagugccgggccuugagcucgugcugccccacccuuccgcgucagcacgguugggccaggggugcaauggagggcagccgagccgagaggcccaggcggggccugcugagggggacgugcggccuccggagucuuaguucagcugcugagagcguugcucggccucgcucgggaagggguuaggguccggagagcgagcccagggagaaggggcgagguguguggcggauccggggcgcgcacaggagaaccggaagcccagcgguucugcgcuugggauuuggggguugagguugaggagggcuuggggggcggacggcucuggggcaggaaucggaguuggcggggcccugcccgcgggcaaacuaccccgaaugucugaggucguccgagguggucggcgucgggggacaguucagucgauugcugccgggacaaaguguaaagccgaggagugucuauuccagaguggggucauuaaaagugauuagcucuagaguaguguuaaaagucacggaaggcugaaaaguuguggaauccaucugaauccuagcaggcggggagaacuuguaggauuggcagacguugucuuuaaugccuggaaguucugaaaaagauagggagugggaaggagggacguuaccgaagaauuucaguauuacggcucauuagaagauggguuuguauggacacagacacguuucccaguccggaaacucaaacauagaaacaucuggcuuuaaugaauuugauuuucaacaccggcuuugucuugaucccugauuuagguguuaaaaaaauucaguugcauuguuagguuuuuguuggugguguuuuuuucucuagcaaauuccuucugaaaugcugaaaauacucuuacauaguaucuuauuuaucuuuggcuuaucuuugaaaggaggagcagaucuaacuccaauuuuacaugcuaguggaggaacuggcuuaguaaaggguuaagaucugugcagauccugaagaaaagugcuaguugucccucuaaccaucucacaggaccgaaacgauuuuaugaacgaaacaaauuaaugaauaauauauuuuacugaguauuuuacuaaacaaaaaagugacuagaucugugaagcauacucaaguaaguuuuccaucuguauuugagaaauucuucacauuuauccaaauuugauuucacugguuauaucaaugaagaaucucaaaauggagcugcaacuggaagaaucugucaugacugccagccucccauuuuauucaccaggucaaggguuggcauucaguaggaucuggcccaaugaagggugccaagugaccugugguuugaucuggccugcguagccuauucauggccauaucccugauugaugcugaaacccaacuuugaauuugagagugagccagauaaacaguccagccauguaguuggaguugaaauguggcccuauguacuugaccucugauauucugggcuaucuuguucuuggaucugaaguuauucagcuuuuuucuauacccaggcuaggauuauggacaguugggaauugguguggcauuguuugaucuaacuguagagacauuuuucuggucuugaauuagcguauuuccaggacgucacuccuuaaauuuuugauguaggccugaggcuuggauaacacaaguaccauccgcguuaucuguuguauagacauuuuaagaaaguacauuucaagcaggaaaugauuuagugggauggcaacuuuaaucuuuugugucuuguuacucuggccccugguuugcagugggcagaacacuaguuuuggaguuagaaagcaacaauuugagauuggagaaauacauugcugcaauuuucucaaguacauacauaaaauaguauuuaauacauacguaacuuucauacacuuccacuuacuauaucuuguuuaauccuuaugacauucuauugacaaaugcaguauaauuuguauuuaaaguaaaguauuagaagaguaaucuaagcuuuuuucuuugaaggaguauaguugaguauuauggagcuggaguuggagaauauugugucugcuggguuggugugugccaugccuaaauuauaaaacucuuggcucugaacuucuauaagcaagcaaggauauuacuucucugugugacagaagauguaggaaagggguugacuuuacuuaccuuugcccuaaaauccccucuagcagcaauuguuguaucuuuacuggcaguggaaaccauauuaagguacuucuuaaacaggucucauuuuagguuaaagacauuuguugaaauuguccacaaaguggcaaauauuuguuggcauagaucuaagcauuucgagguggcaguaauaaaucaguaacaaaaaugguaaacauuuaugaugugccguccauuugcuaggcucucuuaugaacauuuuuaaguguaucaacucauuuaauccuuaccgcaaucccaagaggaaucuccguuugccagauguuggaagcagguagggagaaguuuaaacuugccuaaggucacacagcuagauggaaccagaauuugaaucaagguagucaggcuccacagucuguggucuuuaacuauaguguuuuacugcuucugcacaaagguauauauaguacaggaaaucagaacuuuaaaagagcucuuguauuaaaggcacuuacauuuuaguuguguaaagaaaugugaagucauuaaaaaaaauugaacaauuuuaucucuauuuucuuucuaaggacuuagaauucuuuuccccuucuuccagaggcagaaaaaacaaauauuuccccuuucaacucuuuuuaauuuauuuggacuuuaaaaauguuaaagcagauucaguuauagggaacacauuuuuacuuugagacuaaaaaaaggccuuuuauuuuugugugcuuagagauugccuguauuuuacuuuuuuucugaaauuuacaccuaauuuaauaauuaaauacacuuauuuaaauaauucauaaaauuacauauacucuuauacauaaaaauauuuuguaaacugcuaaucccuguacucaaauguuuauuuuuguaucuaauaaugaugcuaguuacaauuuagugagcaccuaauauaugcaagaugcuuuuuguauacaguuuuguuuaauucuugguacauaccuguaagauagguauuuuauauauguuuuguggaggaugaaacugagguccauacaggguaaguagcuugcccagggucauauaguuuuccagaggcuugccagguuuucugacuuaaaaacuauugcauugugacuuuaauaacagucaccacuuauugaguacuuucuauucuucaggcacuguacugagcauuuagcauguguucuuugauauaauagucuucacaaaaacccuaugagauaaauauuauuauucuauuuuagagcuaggaaaagugagauuuagggagguaaguuaacuugcccaggucuaagaguugaaaauguaagaggggcagggcaggguggcucacaccuguaaucccugcacuuugggaggccaaggcaggaggaucacuugugcccaggaguuugagaccagcaugggcaacacaaugagaccccaucugcaauaauaauaaugaugaggaggaagaaaauguaggugauaagguucucauauugggccuuuugacuucuguuacgaaagcuguucauuauuauacauggcuauuguauaugucuaauugagauuacagauaagcgcucuaagguuagaacagcaagagagggaaaaauagauuuuaucuugauguuuaagauuuuaguauacucauaugagaacugggagaaacuuugaaaguauuuuuuacauauuagguaauuucauugguauagaaugauucuuaucuuguuuacauauuauugaaugacuuagauaauuuagaugauaaaaucugauagauuuuuaaguguguuuaccuuuuuccuguuagucuuauuacuuaaaaucaaauaguacuuaaaauaguaccuugugucaacaugugauugauucaugguucagaguacaaguguuaugauuugacaacuagaauagaaggugaauuuauuucaacucuuuucaaaacuaauuuuaaaauuucacauuuaaaaaugaauauaggcuaggcacgguggcucaugccuguaauccuagcacuuugggaggcugaggcaggaccaucacuugagaccaggaguuugagaccagccugggaaacauaccccaucucuacaaaagaaaaaaaauauauaaauauuuauauauuuuuauuacauaaaauauaugugcauaguuauauauuauuauguuaaaaauauguaaauauauauauauucuuuucuucuuugucucuacaaaagaaaaagacagcaucucgucaauaccccaugucuaagaaaaaaauagacacuuuuuauaucauauauauuaaaauauauuuuauauaucuuuuaauauauauuuugauguaaaaaaugcucuauguuuauuaucgaauauuuguaaaauauggacccacagaaacaaaauuuaaauuacccuugauaucacuaccuaaagauuacuagucacccuuuaaauacuguuuauuaucauuccagaucuuuuacuguagauguauguauuuuucaauuuacuguuguccuguuugcuguucuguauuugcuuuuuccuccuuaacauauaguaaauacuuccuuauguuauuaaauauucuucuauauuguauuuuuuuucuuuuuuuuuaaagggacagggucuugcucugucacccaugcuggaguacaguggcaugaucauaguucacugcagccucgaccuccugggcucaagcgauccuccagccccaguuucucaaguagcugggacuacaggcacaugccaucacgccuggcuaauuuuuuuuuuuuagauggagucucgcugugucacccagacuggaauuuaguggcaccaucuuggcucacugcaaacucugccuccuggcuucaagcaauucuugugccucagccuccuaaguagcugguauuacaggcgugcaccaccacgucugguuaauuuuuguauuuuugguagagacacuguuucaccauguuggccaggcuggucuugaauuccugaccucaaaugauccacuugcuuuggccucccuaagugcugggauuacaggcaugagccaccaugcccagccaaccaugccuggcuaauuuuuuaaauuuuuuuguagagauggggucccacuauguugcccaggcuggucuccagcuccugggcucaagugauccucucaccucagugccccaaagugcugcgauuguaggugugagccacugugcccagccaaaauuuauuauggauacauuauauuccauguaaugacuuuaugucauuuuguuuaauuggucccguguuauuagacauuuaggcuuugugguuuuauuuuauuuucauuuguguuucuuguuauuugacuauuaugagucaugagguaguuuugcuuuacagaaauuuuuuuuuuuuugaaacggaguuucgcucuuauugcccaggcuggagugcaauggcgcagucucggcucaccgcaaccucugccucccggguccaagcgauucuccuaccucagccucccaaguagcugggauuacaggcaugugccaccauacccagcuaauuuuuuguauuuuuaguagagacgggguuucuccguguuggucaggcuggucccgaacuccugaccucaggugauccgcccaccucggccuuccaaaguguugggauuacagccaccacacccagccuggaaaaaaauuuugaacucauuggugauaaauuccuagauguugaguugcuggauuaaagguaucaguuuauuuuccuucuaucuguguagacuacucugaguucauuuuggcauuauccuugguaauuuggaagaaaacauauuuaaaucagagacagguccguagagaugucuagaggaugcuuauauaauucaaaagugauaaugcucccaauaacuuuuuuguuucuuccuucucuaucccuuuacuuuagcuuuuaagugaauuuugauuuuauuaaucacauauaguugaaaaauagaauauauuuauuguauuugguguacagauaauggugguuaugaaaauggauuugaggucuuguuacaauaauucuguaggcuccugcaacccagaauuugugaaccacuaguuuggaggcaugcaacucccaggagaccggauacuauuaugcccuuccuuuucucccuuuucucccuaucuuaaacugagauuuaaggacacuggcccuguuugggaaccuuacuggccacugaaaguucuguguuuuucagucugggacucuuagaacuucagaaaaauaaaaacacucaagauggaagaaauguacucaggaugagaauuugagucuacagagcugauuccuagaauuagauauuugugacuuuuggcaaguuaugauucuuuucugagcgucaguuucuuguguagaaauacuuuuuaucuugaucaaauguugagagguuuauguacaauuuuuugggcacauggguaaaugguucuauuauuugcguuaacuuuuagguaaauauuuaaauagauuuuuaauaaaugauuuuuggccugauacaaagacuuugugauguuuuacguguagauaagauacauuucagccacuuguggcaaugaguuugcuguauuucagucauucaaaaaucguuuuuggaaauaugaaagauuuucuagacuuuaauuuuagagauacagcuauuuauagacauuuuaauauguauaaaauguuucaaagaauguacaguugagaauuuagagaucccuaauuacuguuuguuuauaauaccauuugucagaaaucucugauaagagacaauagaaaauuuauaaaauuucuaggucuuuauagguucaaucuuaggauaguugauccggguaucuucucugcuaccggauuucccagggcuuguuuugugaauggcugguucuguagauuguugcuuauuaagggguggucagauaaagcucugagaaguccagcaguauuaaaaucuauuaauaugggggacuuuugaagaaaauauuuuuuaacaucuuugcacauugggaagauguuucaguuagaaaauuuuuuuguuguuguuuaaugagaacuucaggacuugguuacgaauauuucuaaaaaucugugaagucaaaguaacauucuguagaauacuguguauguauauuuaugcuguagauaaacaaagauauuguuuguuuaauggguuuugcuuaugaugaaauuuuacugauuaagauuaauccauguuuaaaaaaguauacaaagagaaaggaaauaucauagucauuaucuaggaauaauuuaaguagucuaauauaaaucugucccuaaaaaaguuguugaauggcagcuaacuagauugaaguacccuaacauaacuuauauuuugaauugguuguuaauaauaauuggaaaacuaggcuauguuuaguccuaagacuauaggguuuccucucaacacauuuuagcuguaucccacaaauugugguauguuacauguucauuaucauuuaugcaaaaauguuuuucagauuuuauuuuggcuuauucuuugaccuguagguuuuuuuuuuuuuuuaacaaauguauugcuuacuuuuugaacguuuggggauuugcuaguuaucuuucuguuacuaauuucuuaauuucacuaugauuagagaacacacucugaauaguuucagaccuuuauugauacuuauuuuauggcucagcauuuuuauaaauguuuauguacccuugaaaagacuaugcauucugcuguuaacuacugucuucuauguacuuuguuaaguucaaguuuguaaauuguguuauuguguuguacaaaucuucucuauccuuacugaauuuuuuuuuuuuugccuuuuuuucuauucauuacagagagaggugucuugagguuaagugucaaaugugucuuacugugauuguggauuuguauauuucuccuuuuaguucuauaaagaacuaaacuguaugcuuuauguauuuugaagucauauuacuaggcacauacaaacuuaucuuucuaguacauuggcucuuuaucauuauaacaugucccuuuuuaucucuaguaacacuugucucucgccucaaagucuucuuagcuacaccugcuuuauuuuggcugcuguuugcuugcaugguaaaacuuucucucuccuuuuugcuuuuaaugcuccuguagcuuuauauuuggggucuguuucuuguuaagaauaaacagauuuuuguuugccuguuuuuaauuaaaucugaaauauauuuagcucauuaaugguaaauauaauuauugauaaauuuggguuuaugucugucauuuuauuguuuucuguuuguccuacuuguucuauauucuauuuucucuccauuguugccuucuuuuggauuaaucaaguguuuuaaaaauauuauuuuauuccucccuuuguuagcuuguuaguuauauauucuguuacuguucuuuuggugguuacgcuagaucaccacaagcuuucuugugguacauuagaguugcauauucauuaggauuuugaaaaacaacaucucagacauuguuaggacccuagaaaacuuuaauagcauuuaucacucuccugcuuuuauguugucauugucaugcauuucacgucuacauuuaaauccagagacuguuguuuuguacaguuaauauuuacccuuuccauuguucuuuauuuccuuuuguauuuacaugcuuccaucugagauuaauuuuccucugucugaagaacuccuuuuagggaguuuggugguacugaauucucaguuuuugcuuguuugaaauuuauuuauuuucaucuuugaagaauauauuaaaugacuguacaguucuacauuauuagcuguuauuuucuugaagcacuuuaaagaucucaguucauugucuucuagcuuccauuguuucuguugcaaaaucagccgucagacuuacuguugcuucuuggaagguaguaugacuuucuuguucagcugccuuucuuuuugucauucucuuuuucuuuaaguuuaaacagcuuucagugaugcaccuaagaaugguuuuguuuguacccuguuuggcguuucuggcaccucuugaauuuguaguaugacugaucagcugugaaaaaauuuugacuuuuuaaaaauauuguuucugccccauuuuugucuccuuugcucugugacuccaauuaaaucuuuauuauacuuuuuaucccccauaugucuccugcucucuucuguuauuuuuaugauuuuuuuccuccucuuauccguucuggauaguuuuuacuugacuguauuucaguucacuuauucugaauuuaacuauguccaaucugcuuuuuaaccccaucuauucuuaauuuuaguuauaguauuuuuuaguuuuagaauuauuucauccucucuuuuuaagauagauucuaauuaugugaaaaucucuugucauguauuuuuugagcauauuaaucaaauugcuuuaaagucugugucugaaaacuucaauaucuguaucaccuauaggccuauuuccaucaucucuuuccuuuugauuuugcaucuuguuaggccaaauaauaauaauaguuaauauauuuguauauuaauguauguuaauuauauauucuauuguauauuauauaaauuauuacauguggauaauaacauaauaguaauaauuauuauuaggcaauuuuuugauggagugccagacauuauaugcagaauuuuagauacaaauuuuguaucuauaaugauacauuuccccagauaggauucacaugucuucagauucacccaucuucuugcaggcagauagagaucacugcaacugucaaggacugagcugacuugagguuggguuuucagccuuauaaaccuuguucuaccuguaguuugcuuccaacuugguagcccccuagagaucucaauuaagagauuggguauuuuuagggcuucucuggcuuuuuuucuuuccagacccaugagaguuuuaaaagcuccuucuuccuuuuuaauugcuuucugcuggcuuuuuagccuuuugcuaugugcaguuuaaaagcugauaaaucccuuaagaggaaaaucaguacugagugucacauuuguucuucugugccuucuuucacuaggggaucuugacuccucaagacuuagcuaccaaguuuugucccccuacucccaugaaauugccaaaagcuuugcugacuucucugccuccuaguggcuguccuuuuuuggcuucuuagccccuuggccugugccauuaaagaaauaggugacaugucuugaaagggaaagcugcacagaaugucagauacccuucagugaguuucuugccaccucaagucuuagcuaccucagaaagucugauauuuuaagaacuuucucccuauuuaauacaguuuuucuaguuuaagagggaguguugaucugcuacagacuauuccgucauauucaaaagcagaaaucuuucuguguuuaguucuuuuggaauagaguguuauaucuuguaggccugugaguuucucaugguuauauuaauguaaaaacguacgacuugauccccagaguucuuuggucucuugcuaaguguuuuccuucauuaacugcuuauucuugcuaucugaugggaaagaauuguggaacuuaaauacaguugacccuugaacaacauggauuugaauuugcagaucuacuuacacgugauuuucuucugcuucugccaccuugagacagaaaggucgaucccuucucuuucuccuucucagccuacucaacgugaagaugacaacaaugaagaccuuugugaugauccacuuccauuuaaugaauaguaaauauuuuuucucuuccuuauaguuuucuuaauaacauuuuccuuucucuagcuuauuguaagaauauaguaugucauacacguaacacaugaaauauguguuaauugucuauucauguuauugauaaggcuucuagucaacaguaagcuauuagcaguuaaguuuuaugggagucaaaagucauacauggcuuuuucaacugcaugggaguuggcgccccuaggccccacauuguucaagggucaacugacuguaacaugauuuguuagcaguuguuuuauucuuguucuuagccaaaaaacugagaaguuauuguuaagcaguuguuuuaaaugcuuauuaagaguuaaaaugagauuuuauuuuugguuucauuggugauuugcacauuucuuuugagacuuacuuguuuauaagguuaagaaauugagaguuggucgggugcacuggcucgugccuguaaucccagcacuuugggaggccgagguggguggaucacuugaggucaggaauucagccuggccaacauagugaaaccccgucucuacuaaaaauacaaaaauuagcaggauguguuggugcaugccugugcucccagcuguuugggaggcugaggcacgagaauugcuugaauccaggagguggagguugcagcgagcugagaucgugccacuguacuccagacugggugacagagggagacucagucuccaaaaaaaaaaaaauugagaguuuaaucuuucuauaaguauaguauuucccuucauauaauaggauuuuuaaauuauuuaccuuuuuguuaggacuuuuauggaaucuuauauuuaugugaagauguagguuuagaaggaagauaauuggguuugguguaaacuuugguuuuguaaauguuaguauuuaauacuuuaaaaauauuccuacuuuuuuuuuuaguaugacuaauauuuauuauggccaguaucaccuauguauuuuuuguuaaagaaguugucuuauauacauagaaaugguauaauaagcuacuuuaaacaacccuggauauguuucuuuucccuuccugucacuguccucuuucuucccuuuucccuuuugauuaagaaguuccaucagaaaagucauaaaaucuaacuccuguuuauucucgagcuaucagcuaaaaugucacuuucucaggaaauccugccugaccccccuuuccccuuuguucuggcacccauuccccuggccuuuaaaugcuuucauagcaguguguaccuaucuaucauuuuuuacaguuuguaauuacggcuuuuuuuuuuuuuuuuuuuuugagauggagucucgcuuugucgcccaggcuggagugcguggugcgaucuuggcuuacuacaaccucugccucccagguucaagcaauuuuccugccucagcccccccaaguagcugggacuacaggugcgcaccaccacgccuggcuaauuuuuguauuuuuaguagaggcggaguuucaucauguuggccaggcuggucucaaacuccugaccucaggugacccaccugccuuggccucccaaagugcugggauuacaggcgugagccaccgugcccggcuuccuguaauuauguauuaaaauguauaauuacuugauuaauagcuaucuucccaacuagaccaaaaacuccauagaauguauggaauuuuccuccaucauccuuguaguccaagcauaauauuuauuaaaugaguaaaugagugaauuaacuagccauuuugauuaauuuucucuuuuuagugcaguuuugguuuaggacuguaaggagucauacuggccauauucagaaugucacauuaguguuuuaaguccauucuguauuuuuuucaaugaguuucagcaaaaucugagagugucuuaagugaaauugguuauaucuaggguggagguauuauauuuggaaagacuuguaacaguagaaagcuuuuuauuuaaaucuuugaguuuuaaaauauuuuuauuaugaaguuauuuaugauuuuauagguaauauuuuuaaugagaccuugaaaaauuuauagagugcaguuuauuacagaaucugaguugccuaauaguuuuuaauaguuuuugaguaucaguauuuugauuaauuuuaaguuagggaucauuuccucuaauucuuugaacauaauuauuuguugguugauuuuuuuuuuuaauguaacaguguuuuugagauguaauuuauguaccauacgguucuucuacuuuaggguauuagauucauggauuuuuuguacauucacagaugugaccgucauugcagucaauuuuagaacauuuucauaaucucaaaaggaaaacuguagccuuuggcuauuauccacuuauucuuccaucccugagcaaccacuaaacuacuuuugguguguauagauuugccuauuuaagacauuuucuauaaauggaaucauauaauuuauggccuuuugugauuggcuuccauuuaggauguuguuuucaaaguuuauauuguaucauguaucaguacuacauccuucuuauugcugguaaguauucuguuguaucgauauaccacauuauguuuagccguuuauuaguacagugguccccaaccuuuuuggcaccaaggacugacuuugugcaaggcaguuuuuccauggauggggugugaugggggaggaugguuucagaaugaaauuguuccauuucagaucaucaggcauuagauucuuauaaggaacaaaaccaaaacagcaacaacaacagugauucucauaaggagcacccaaccuagaucccuugcaugugcaguucauaguagguuggugcuccuaugagagucuaaugccuaugcugaucugacaggaggcagagcucaggcaguaaugcuugcuaacccaccgccacucaccuccugcugugcaucucaguuccuuacaggaaccaguacuggucuguggccuggggguuugggaucccugcauuaguugauagacauuuggauuauauccacuuauuggcuauuaugaauaaugcugcuauaauaaacauucauacaaguuuuuuguggacaugguuucauuucuuggguauauguccagcaguggaauuucugggucauuugcuaacuaugauuucguuauuggagaaacugccagauuuuuuguugauuuuuuuuuuuuucuguuauuauguagugucaagaaaccguuuaaugcauaugaauugaagcccuguaaggaaagugaucauuugggauuagaucgcaaauugcuugacuucaaauguauuacuuugagaauuuucugugacaguuuagcuaguccuuuaucuuccuuauuuuucuugagaauacaugaauuagcucccugccuucauauuugaagauacauaccuaucaguguacagacauguacacacauagguacacauauaauacuuugcuaagcaguuugugcuggggacaauaguugaaacucgguguuuuuuccuaaaauuuauaucguuuguuuauauaugaaauaucaaaugggagauauuuuuggaagcagugaaacuuguuuaugaauucuuuccuuacacaaaagaagacagguuuuuuaaaaacaaauuaaucuuuuucucuuuguuucuuucagcauugaugacugggaagugagagacauagauuuuugaaaagcugaaaauaacuucuaguuuaacaaaauaguuucuuccagagcuuagaauuucagaugauuggaaaauucauacaucuaggucugaaaguuuaagucuuucgcaucuauggagaucucuauuuucuacaaccuaaaaugcuaugaugggugacagguuaaagacaaaccuuuuuaaaaaauguauauuuuuauugcuauauagugguauuauggcuuuugaaauuccuauuuuuaccauaaacagauuauuaggugcuuacugauuccagauaauagccuaaucuauuagaagguagaagagagaaucucuggugauacacuguccauacaugguucaauaggagguagcaaaggcuaaguaugaguaagugacaaaagcaguaaaugcugcagaacugaaauucagagaauugcgcuuccacuguuggguaaggcuuaaggggagacuuugaaagaggaagaugagcuaugccuuccuuuggguacugauuuaauuucuuuugccauuuuuuugcauuucuugaauguaggaauuuauccuuacccaugugcauauucaucagcuccaauuuaggagauugacuaguguagcacgucauaaccagaaagauacuuggagguagacuuuucccuaaaguuuauacaagacacuuaaugggcuggguccuugaucauguacuucuuucuuagacuuuguguauaugaagugguguucuuauccuuauuucuuuccacauucacccuuuuuaaugcuuuuaguaagucuuuucaguuuuuguuaagauuuauuuuauaguuacacuauuguauuuauugaagguagcuuggcugauacuguuccaaagucacuugccacuuuccucucugcauaauuaacauuuauucuccucauuauuugucaaugaauucccuucuguuuauuuauaguuucuuuaugauucugcauaucagaagauaacaagcacuuaucacaaaugcauuuaggggauguacuacucuguaaaaaauuuaaauauauugaaaauagaacucuuugaauuuuauuuuacucuuuugaggaaaugaagauaucuugauuuuuuuuaugguauucuaaccugcuuuuccggggcauacagggcagcacuuauuuuuauauaaaucugagaaugugugaauugcaaauuaaucuucuggcagauaucuaaugcuguugauagagauguguugcccuaagauuuauuggauuuaaugagacagucuuuugauauauccuugaauuaugaugggauauuggguugccacauguaaguuuuagaauauuuuuuaaugauauagagaaaaugcuucagauacaauggcauguaaaagagaaaacagcaaaaaaacccugauuuuaaaacgguuugauucaauuuauauuuuaaaaacacagacacaugauuuguaugccuguguauauagaaaagauugcaaggauauuuaccaaaauauuaagugauuaucucuggguuguaguaauuggggugauuuuuauuuuuuaagugccuuuucuuuggguauugccugaaauguuaaauauuaucucauuuuagcaaauaauaaauacuacuuuuaacuaagaaaaaauagagaauuguuguguuugugugaauugcuuugauuauaaacacaaauuauauaggauccuaugucccauguuagugaguuucuuuuuguuuuuuuaaagugaggagcuaucaaaggauuuuuuaauagaaaagugaugugaauaaaguuaagucuaugguuuaaaauuaaaaauuuuaaguacucuuaugacccagcaauuucaguuuuuaguagcuaauuuugaguaucaucaaauucaggcaugcuuaucccugggauuacacguagaccuuccacuggguaugcgggcaaaaauaguuuuaaaauacucaguuuccuaagccuuacuguucuuguguauucuuuccuaaaauugaucugccuaagaacuugccuguggcuuaugcccuugcuccucaaaaguguggucuauucaccagcaguauuguuauugcugguuguuuguuaaaugcaaaaaacgugguucucaauucuuuuaaacaaaauaaaaggaggaccuaaucaauuugucaguugauggaucauaaauaauuuuuuuuuuuugagcuggaucuugcucuguugcccaggcuggagugcaguggcgccaucuuggcucacugcagccuccaccuccuggguucaagcgauucuccugccucggccucccgaguagcugggauuacaggcacgcaccacugcgccuggcuaauuuuuuuuuguauuuuuaguaaagacgggguuucaccauguuggccaggcuggucucgaacuccugaccucaggcgauccacccgccuuggccucccaaagugcugggauuacaggcaugagccaccgcaccuggacugauagaucauaaauauuuuuaaugauagcucguuaugcgauuuuuggcauguaauuuggaaggugguaaaaaaaauuaguaguacaggaacaguccagguugaguaucccuuacuugaaaugcuuaagaccggaaguguuuuggauuuuggaauuuuuacgauuuuggaauauuugcauuauguuaauauauacuuagcaguugagcaucccuaaucugaaauuugaagucugaaaugcucccaugagcauuuccuugcagugucaugucagaacucaaaaaguuuucagauuuuggaacauuucugauuuuggguuuucagauucucaaacuguaguaacagaaauuccuucagcucccuuguauuuauuuaugugagcaagggaggaucauagaguccagaaguuggagaauagcuuggguaacauagcgagaccucuucucuacaaaacguuaaauuagucgggugugguguugugcuccuguaguucuagcuacuugagaggcugaggcuugaggaucacuugagcccaggaauucgaggcugcagugagcuauguucaugccacugcacuccagccugggcaauggaacgagacugugucucaaaaaaaaaauuuaaaaauaaguacagaguugauguugaaucccauuuuauucuagcagugauauuuauucauauauacaugagacaauuguuuugaaaguacacgugucuuugagaaucguaucuaauaccuuuacuguauauuuaaucaucaucugucaaaguuuuuaauauauuguuuuggucaauaauauacuuaugaaauugauaauaacauccagaagaaauuuuaaaaaucacucggaaucucaugaucaaaaaccaaaaaaguuuaaucuuaauucacguggcauuuucucagagaagucauaggagugaaaaaugaaagaccuuccagccuauaaguaaaauuacauuuacauuuuguaaaauucuuugggggaaguuuaaggagaaaccaagauaauauaaacuuuugacuguauaagaagaggcuguucacuuaaaaaauagaugaugguauuuuucuucuauugauacuuuuaaaagaacacauauaacaacuuuauuaaaaauuaacaauauuagggcgggugugguggcucaugccuguaaucccagcacuuugggaggccaaggcagguggaucacuugaggcuaggaguucgagaccagccuggccaacauggugaaaccugucucugcuaaaaauauaaaaguuagcugggcgugauggugcacaccuguaaucccagcuagucgggaggcugaggcaggagaauuccuugaacccgggaggcggagguugcagugagcugagauugcaccacugcacuccagccuagugacagagcgagacucagucucaaaaaaaaaaaaaacccaaaaaacaauauuuaaaguacacuggaaaucacaaccuuugcaacaauuauaagguaugaaacauuuuacaacuuaaaaauguugaggaugugcauagauuuucaaaauuaauuuagaggguacuugagcagaaaagcuugugcaccauuaacugacagcaguuugcacuuucgaauuacuugugaaucuuuuaaaaaugcugaugcuccuagguuauaaaauaaucuauuauuuugggccuaggcccaaaguacuagacuaugaugaagaucccacaaaagugauuguuuuucuauaauuacauauacacauauauuuauucuguaguuacaugcauagauagaaaaaagacuuggaaucuaaaacaaaagcaaaaagauaaggaaaauauuaaugaaaaauugaaauggaggcuagccuugauccagaagguccaccuucucaccuucaggacacauggcuuaaugagcagaugaugcucuuugacugggauacaggacuugaugggugggacacaggcugaauuucagcuuucacucuucagugggaucuucuagugcauggugcaaccugcauaauuauauauagcagcccugcaccuucuacauaauaauaggccuagaaagagauuagaaacaaaauagaaacgaaaggaaaaaauagaggaaaauuuaucugagcuaaagaaaggcucaguugaagucauuaguuugaacagccuugcugauugucaagagaguaagugcaaaaguauccauaauuagucugcauucagaugcaggaaccuggugcuagagaagcugcucaggcacaggaacugggcauugaagcuguauaugcugcuggagccugaugcuggagaaaccuguauggcaggaaugaagagcuagagaagcuguguaugcugcaagagcaugcacggcaagcauaccugaaccaagaagccaaacaaaaacaaaaaaaacccaaagacaaaaaacccuuacuugcugcgaugacuccugcccccucuuacugacacagcuuaacauugcaccagcugguaaaggaaaaauaaagggcccaaauccauuuucaaagaggagacaaaaagagugaauuuagaggugagagucaauaaauccauaauuggcucguuuacuuuuaccuuuugaugugauuuuaaaaucuguuuucucagcauuucauuuauacuuaaacugguuaaaucuaguaucugaaguuuucuuuugguuaaucugaugccuauuauuguuucaaguggauuaauauuacuaguaagcuuuuguguuucuauuuuccauucauacagugcaauaacauuuuuuaaauugcaaaaauggauaccgaauuauaaagacaguagugcuuuugaaacaaauguuggcuggcaugugagguaaucauaguauaguaacaaacuaaugguuugugaccugaugaacauucuguauuuaacaaaggaaaggcugagagcucuaagauacauaagugugaguugucugacaguugagugaggagaguuauuaccuguaauaaacuugauuucaguuauaucacuaaacugcucauguuccauauauuauuuuaaacagaaaagcacuccaaaguuguauucugugcuacagcuaucuauauugugauuugccauaugacauaucucuuauuaauauaugaagagagcauuaaaacagccuugccuauuuaucagauauguucuagguguuaauuuauuugugaauuuuaugcgaacagauauauauauggaaaugaguuuuugaaaguccagcauacaacuacagccauuaaucaaggacacauguagaaaauaauucauauauaugcagagauguugggagaaguuuuauuccaaagcuaacacaaaacaagguacacaaguuuuuauagaggauauuauccauugcgguaauauuugauguauaauacuucugaauuuuuuaauaguuuuaagaguuaacuauagucguuggguuuuuuuuuuuuaaagacagggucccacaaauguaauuuaaaaauauuuguagauccucuggaguaucucugaggaagagaguuugaaaaaugcuuuaccaugggacuuagggcauuggucaaagauaccuauuauggguaugagaggagaguucuuauuaaguaagcagauuuggauuaguuaauauugguuugaccugucauccuuaguacaguuuaaauuauuguauuauacuguggcaaaagcuggaucugaugcaaaggaaaacaugaaagaauugagacaguaugguauagagagaacacugaccuaggacugggacuugaguucuaaucccaguucuaccaccgauuaauugguaguuuuagaucggucauuuaauuucucuagccuuuuauuuuuuucucauacaaaaugagggauuuagauucugaagguauuuuuuugaugcaaaauagcaaacaguugauauuacagaguaauuuuuuaaagacaugcacccucccccacauccacauguuauaguucauauuaagcuacauuguugcccaacaaagauauuuuaagaacuugauauaauuagaugauaaugauuauuuuaguaaaauuaauuacauauaaaugaagccuuugagagugcuuagaagcaguuugaucucuuaaaucuaucuuuuuuuuuuuugagacagagucuugcucuguugcccaggcuggaguacaguggcacgaucucggcucacugcaaccucuaccucccagguucaagcaguccucuugccucagccuccugaguagcugggacuacaggugcgugccaccacgcccagcuaauuuuuuguauuuuuaguagagacgggguuucaccauguugaccaggauggucucuaucuguugaccuugugauccaccugccucagccucccaaagugcugggauuuaggcaugagccgccgcacccggccuuaaaucuuucuaaucccucugugaauauauuguuauauugucugagguuugaagaauguguguacuaagcaguaaaucauugccagaucauguccaaauuuaaugaucuuugcauuagguagaaaagggauaguucuuuguuuugaaauauauucugaagggucauuuaauuucugaaaagauugauaauucaagccuucugagauauucagcaauugaggacuauuuuuauaugagugucucagcagauagauuuuuuuguuuuggggagacaccaaaucauguuagcgagcuuuuuaguuucauuuuugucuagugagaauuuccuauuuuaucaaacuucuguauaggaauguuuguuuuauuuuguugccauucuuuuuuccuaguggucgcuccauucauucuuguggaguauguuguagguauguguucccaaaguguuuugaauccuuagagauaauuacuacaugcuuauuuucaguugcuugguagugauaaguugacuugaguuuugcuuugagugaugguaacuaacgauacuacaauggucugcuauuugcuaggccauugacauucuguaauuuucaaccuguauuuguacccaccucucuuucuucugguauauuuuaaaguaaauauaaguuauguuauuuuauuucuaaauacuucaguauacaugaagaagaggacauuuuauuaguuauuuuuuauuucauuuuauuuaaaaucuuuuuuuuuuuuuugguagaguuggggucucgcuauguugcccaagcuagucucaaacuccugggcucaagcacuccuucaccucagccucccagaguucuggaauuacaggcaugagccgcugcaccuggccuucguuaucuauuaauccauaacaaauugcuacaaacuuagcagcuuaaaacaauacacaauuuauuuucucaaugaggguccaguguuuagacauagauuugagaggucuucugcuccaggucucuaaggcuacagucaagauguuggcuggggcugugguuucaccuaaaggcuugaguggggaaagaucugccucuaagcuuauuugauuguuggcaggauucaguuucuugcaaguuguugcccagagguuguccucaguuuauugccacgugggcaucucuaaugugguguuuugcuucaucaaugccaacaagggaaagucugcuagugaaguggaagucacaguuuuauguagccuaggcccugaaaugaugucccaucaccuuugccauauucucuucauuaaaaacaagucacuaggccaaccuacacucaaugagaugaaauuacaaugagauggaauuacucaauggugugaauucucagugguggggaucauuugaggccaucuuugaacugcccugccagagacauuuucuuuuauggccacaaugucauuauuuuacuuaacagauuuagcaguaauucuuuaauuacaauuaauaccuaguccauauuuaauuuucaguuuucuaaaaaaugucuuuuuauaguguguucgaaucaggauccaaacgcuuauugcauuuguuguuaugucccuuuuacaauucuuuuuaucaagaguucuuccauuagccaggugugguggugugcaccuguagucccaacuacuuuggaggcugaggcaagaggauugcuugaguccaggaggucgaggcugcagugagcuaugauugugccaccgcacuccagccugggcaacagagcaagacccugucucuuuuaaaaaaacaaaaagaagaagaagagucuucccauccucuugcuguuuucuuuuuauccauugauuuguugaagaaaucaggucauuuguccugaagaagcuccccuauucuagauauguucaguuguuucuaugguggcauuugacuaauuccucuauuugucaugcuuuauauauacugggaguuaaacagaaagccuuauuuagauuuuggaucagauuuuuuuugagacagggucuugcucuguugcccaggcuggagugcaguggcacaaucauggcucacuguagccuugaaccuccugggcucaagugguccucccaccucagccucccaaguaacuggaacuacaggugugugccaccaugccuggcucauuuuuaaauuuuuuuuuuagagucaaggucucauuguguugccuaggcuggucuuaaacuccuggccucaagcaauccucccacauuggccuccaucaguuuuuuagaaagaccacucccuagguggugccauauacuuuguauuuuaucacuucaggaggcacaaaaugugguggugacaacuuuuuuguaaagccauccacuuuucauuaauaguguuaauauccaaagauaacucauuguuagaauaaacuauuucaguagaaguaucaaaauuggauuucucucaucuuaccauuccuuucacauuuacuagcuguaauuuuccuggauaaaauuuucccuugucuauuugagcuuuuugguuacucugaaauacaguucuacuggaaaagcaagacaaaugcuuaauucuuuccuuuuaaucacuaguuuucagcauagugaguuguuauauaccuccaggugucuaauuaauuuuuucuuuuuuaaaaacgaaaagcauuuaugaacauuagucucuuuauucauuguguuuuaaaugacuucaguagucauuauuugugaugccagaugguuccaucuuaggccagugggagucccuucaggcucucuccuguguuccuuugacaugaccccauucuuuauuuucuugcuuuuuggcauaggaaaaugacuuuauauaacaugcuuuagucgaagaaugauguucagagugcauaauuggaaaauggagauacuuaauguuaccagauugucauuucuuuuagauccuucuaggugauagagcuaggaaauaaauuuuuuuaagagaaaaaauaucuugaauuuauacugcuauuuccaguucaaauuugauuugugagguuguaacuucuuucauuuuacacuuuuuuuuuuaaguugaaaauguuucccaguauuaacauuaauauaauugcuuugggcccuaucuauguguguguggugcacauaaauauguuuaaaacauaaauuuaaaguaauaucaguguuauuacugggugaaguuuaacauuucuuuguagauucuuuuugccguuagacuguuuucuacugaagauaguaaaaaugcuguguccuaaggucaguuggaauaauucuuuuuauuauuuucuguggguuaugucaccaacuugauacacagguucauuuguuuuaguuuauuuucagcuuuuagugauuccuguuuuuguuucugcauguaaaacauuugcaugguuucagauuuuaaacuaugcagcuuccaccucugucccuucaacacuuuuuauucccuuuacaaugggcuaguucuuccgcugcaaauacaaacaucuacauguguauccauucauuuagaugugccacaauuuguugaaccauucagcaguugaugaacaucuagauuguuuccauuuugggguuauuagaaaugaagcuacuauaaacauuggaguacagguuuuuguuugaacauagguuuuuguuucccuaggaaaaaugccgaagaguccaauugcuggauuguagugguuaguuuuguaagaaaccuucauacccuuuucuaaaauggguuaccauuuuacauucccaucaacaauguaugagggauccaguuucucugaauccuugugagcauuuggugucaucacuguuuuaucuuuuagcuauuaugauaggcauauagugauaucugauuuuuuuuuauuccucuaauggcuaguaauguugcacaucucguguuuauuugcuaucuguauaacugcuuacuggaauguauucaugucuuaccuauuuucugauuggauuguuugccuuuuaccugauggaugucaagaguacuuuguauguuuuagguguauguuuuagguguguguuuagguguauguuuuaggucuuuuguugcguauguaguucggaaauacguucucccagucuuuagcuuaccuuuucaaccacuuaaaagucuuucucaaaauaaaaguuuuuaauuuugcugaaguccaguuuuucaauuuuuccuuuuauacauuuugcuuuuuguauaagaucuccuugccuaguccuagaccgugaagauuuugucuuauguuuauauuuuuuuaaaguuucauaguuuuauauuuuacauuuucauucaugauucauuaauuuuuuuaaugaaguaugaguuuuaggucaauuuuuuuuuuuuggcuuauaguuguccaguugcucuagcacuguuuguugaaaaggcuauucuuccuuuguugaauugcuuuuguaccuuuguaaaaaaaaaaaaaaaaaaaaaccaguugggcauauaugugugggucuuuugggggccuuuuauucuguccuaaugauaugugucuguccaucugcuaguauuauacuuuauugauuaugcaguuuuauaauggagcaagcuuuaauauuguauagagugaucgcucucauuuuauucucauuuaaauaauuauuuuggcuauucuaggucuuguguuuuauguguaaauuucagaguaaacuugucuaugucuaaaagaaaucuugcugggauuuugauaggaauuacauuaaauuuguaggucauuuugggagaauugccaucauugcuaugucgagucuuccaguccacgagcacaauaugucuuccauuuauuuaggucuucuucaauuucuuuuaucagcauuuuguaguuuucaggauacagagcauccuguacauguuuuguuaaaaauauucuuccuucauuuccuuuaaagcaacuguaaauuguuuugugcuuuuaaucuuggguuucacauguuuaguguuaguauauagaaaugcauuugauuguugaucuuauauccugcaacguugcugaacucauuaguccuaggauuuuuuuuugugggggggggcguaaaucuugugggauuuuucacguaggcaaauuaugucaucugaaaauagggaugguuucauuucuucccuucugaagguugcaucauuguuuaguugaaugugucaaguuuuauuuuuuucuggauuuuugaauuagggagugucuucucagugacaggauguaaaggauuuaacuguguuuucuucuguuacuuguauguuuuuauauuuaguuuucugauucauuuggaauuuaaccugguggaugaugugaggcacaaaucuaauuuuauuucuaaauggcuguacaucauuuauaucuaucgaaacauuuaaauacaucauuuauuauaaagcucauauuucccccaaccccaaugauuuaugaugcuaucuugaucauuuauuaaauuuuaugugcuuuguucuauuuauuuuuauuuuuaaauuuuuugguagagacagggucucacuaucuugaccaggcuugucuugaacuccuggccuuaaguaauccuacugcguggccucccaaagugcugggauuacaagugcgaaccacugcagucagcccacucuuuuauuucacuguuuuguauucuguuccugauuguguauucauguauaaauaucuugcugcuuuaauuacagagacuucauaauaugcuuuaacaucugacagggucuagucuucucuccuugcucuucuacucuuuuucaggguuucuuuggcuguuuuuauccuuuuaauuuuuaaugugaaauuuauuauuugugugaacuguaucagccuuauuuguuguauggucauagggaaaccuguuuuuauuuuugggucuaauuaaauuuauaaguuaacauagaauuguauuuuuaugaugagucuuuuuaugcaggaacauggcaugucuuugcauuuuuuccagguuuacuuauacauacauauauauauguauauaucaggacuguuuaaaacaauuuucucauagguuuugcacauuuuucuaagcuuauggcuaauacuguauuuuauuguuguaauuagaggucuucucuugcauuauaucuucuaacugcuuuucgcuuuuauguuugaaggcucugauuucuuuaacuugauacuauauauauauauauauauaugcuuuaaguucugggguuuuuuguuuuuuuuuuuuaaacaggucucuuugguccaggcuggaguauaguggugugaucauagcucacuggaaccucaaacuccugggcucaagugauccuccugucucagccucccaaagugcuggaauuauaggugugagccaccacacccagccuugauauuuuuuucuaacuaaauucuucuauucuaaauaguauuuuucccauugauucuuuuggcaucuucuaguuguauaauuuuuucaucuacaaacacucuaauuuguaugcuuuguaauuacuuuuucuaucucuuaaauuuuagacuuuauccuuuagaacaguuuuagauuuacuaaaauaucgagcauguaauacagagaguuuguauauaccucccaauaguuccccuauuuuuuuuuuuuuuuuuuuugaggaagggaagaaaaggaaaggagcaaaguacaacuuggaagagggccaagcaagcgacuugagaaaccggcagcuugaccucuugacuugggauuuuauacgcuggcauacuuugggaucuugcauuacuucuccucacuccugagaucuuauugagaagcugcugaugaguuucagguguuuuauaucuauuagccugccuuucccuagcuccggcugcaaccaguuauuacuuuagagaaacaguuaacugccugaccaucaccugauggucgccuaacacuccuggugugcaugugggguggagcccccuacugcccugcucauaccugacuagcuacccacuguaacauuuccccccccaagaguccaagaccccaaaucuuugggguuaaauggacgaaggucagucuucuguaacugcuuccugcugacagaggggcaguggugguucuaugggucuuggccucuugcuagcugucauugcugaguuggcuccaugaguuguugaaagcgauauccggccaggcccaagggagacaggggcaggauuucgccucugucgugucccacugaugggcagucuagagguccccuguagaagggugauucuugaauauugaaaggacaguauucuucaucgaggauuaccuggagcuuaauggccacuagggaauguauccaaaucgugugcgccaaauauguugccgguggcagauacccaaguuaccccgauuccguaugggucugccacaacuucaguucuugccuccucaggagaauucgaaugaggggcauaaggcagaaggagggagagacugaggcagguuucagagcaggagugcaaguuuguuaaaaagcuuuagaacaguaaggaaaggaaggaaaggaaagaaggaaaguacaccuuggaagaggaccaagugagugacuugagaaaccaagugccaguuacccuauucuuacuguauuacauucauaugcucuguuucuuagaauuaaugaaccaauauuuauaguucauuacuaacuauaauccauaguuuauuuaaauuuccuaaguuuuucucgaauguccuuuuucuguuccaaguuccuauugaggauaccacaucaaguuugucaugucucaggcucaucuugacugugacaguuuucucgaacuuccuuuguuuuggacugacaguuucgaggaguacuggacagguguauuguaggaugccccucuacuggaguuuggguugauugggaaggaauauauuguaagcaugcccuugaucaccucccugaggugguguuugucagguuucuccacuguaauauuuucccuuuugcauacuguacuuuggaaagaagccauuauacacagccaauacugagggaguacucucaguucuuagaguggaguauuacauaauuucuuaggaauucuucuuuaugggagauuugucucuuccgccauacuaauuuauccaauaauuuauuuguaucauguggacucagauacuuauuuuauacuuuauuauaauccaguacuacuuuauuuauuuuguugcucaaaauguuccggcuuuggcuguuggaagcucuuucaguugacucaugugcgccuuugacauaacuuccaucauuuuuguuuuguuuuguuuuucauuuuagugcuuucuuaauuucugguauuacaggaugcuccaggcucaucuuguuuauuuucugccccauuucuccauagaacuguuguuccuuuuauuggagaaaggcauaaaaaaacaaaaucugggugcuagauguccugcuucggggguuuuguuucuuuuagucccucucauuaaccuuauauccugaaaccuugcuguaaucauucauuauuuccaggaguucaucaguucuuugggauuuucuguauaggcaguccugucaucugugaaugaugacaguauuauuuccuucucaauguguagacuguuuuuuucccccgcuuaucuuauuggauuuagcuagcauuuccaggauaguauugaauagaauugccuuauucccagucuugggguaaaacaucuaguuucucaccauuaaauaugauguuaguuguagguguuuuguagguacucuuuaucaaauugaagagggcugccugaauuccuaguuagcuaagauuuuuaaucaugaauauguguuggauucugugaaaugcuuucucugcaucuguugauaugaucauaugacuuucuucuuuagccuauugauguguaauacauuaauugauuuugggauauugaaauagcccuguaauaaguacguuuuauugugguguguaauuauuuguauacauuuuuaaauuugauuugcuaauauuuuuugagauuauuuuugcauccauauucauaagagauuggcuggagguuuucuuuuagugaugucuuuaucugguuuuuguauuagguuaaugcuggucucguagaaagcauuaggaaguguuuccucugcuauucuuuucugaaagacauucuagagcauugguaucauuguuuucuuuaaauguuugguagaauucaccagugaaaccaucugggccuggagauuuucuuuuuggaagauuauuaauuacuaauucaguuucauuaauaguuacuggcauauucagaaggucgcuuucucgacuuuugguaguuuguaucuuuuaaggaauugguccauuucauuuauguuaucaguuuuaugggaauagaguuguucauuuuauuaucuguuuaauauccaagugaucaauagugaucacucauuuucauuucuaauauugguaauuugugucuucucuguuuuuuucuuuguuagccuagcuagaguuuugucaguuuuauuggucuuuucagguagccagcuuuugguuucuugcuuuauucuacgcauuuccuguuuucaguuucauugauuuuugcccuaagauuuauuuauuuauuuauuuuuucugcuuuguuuaugcuucaguugcuuuucucuaguuuccuaggguggaagcuuaagugauugacuuuaaguuguuuugacuuaauaaaaugcuuucaaugccguaaauuuccuucuaagcauuccuuucacuguaucccacaaguuuugauguuuuguucuuaguuucacuuuguucagaauauuuuuaaauuuaucuggagacugcuuugacccauguaucauuuggaaguauguuuacaccaaauauuuugggauuuuccagcuaucugugaaugacuucuaguuuaauuccauuguggucugagagcauacuuuguguaaucuucaacucuuuuacauuacuaacauauauuuuaucaucuuccuuggugaauauccuugugugagcuugagaagaauacguauucugcuguuauugggugaaauacucugcaaagucaguuagaucuaguugauugaugaugcucuucaguucaaggguauucugagcuucugccugcugagucugucuauuacugacagggauauugauguguccaauuauaauaaugcuucuugaacuucugucaguuucucucucaaguauuuugacacgcuuuuguuugguacagacaccuuaaggauuguuaugucuucuuggagaauugacaguuuuuauuauuauuuaaugccucuuuuauuuuuuuuuuuauuuuuugagacaggguuucacucugucacccagacuggagugcaguguugugaucucaguucacugcaaccucuaccucccaggcucaagcaauucuccugccucagccuccugaguagcugggauuacaggccugcaccaccacgccuagcuaauuuuuguauuuuuaguagagguaaaauuaaaacauguacuuuuuuaccauguuggcgaggcuggucuugaacuccugacuucaaaugauccacccgccucggccucccaaagugcugggauuacaggcaugagccacugcuucuggccaauggcucucuuuuuugcugaugauuuuccuugaucuuauguuugcuuugucugauauuaauuaauauagcuauuccaguuuucuauuuaaagaaugguaugucuuuuuccauuucuuuauauucaccuauuuguaucuuuauggggguuucugguagacaacauauuuggacuuuguuuuuuuuaucuacucuaacagccugucuucuaauuaguuucuuuagaccauucacauacaaauugauuguugauauaauuggauugauaucuaccauauuuguaacuguuuucuauuuacuguacuuguucuuuguuucuucucuuccccuuuuuccaucuucucugauuuaaaauggacauugauugugauuuuguuuucucaucucuuagcauaucaguuacacuucuuuuuaacuuguuuuuagugguuguccuagaauuuguaauauuuaugugcaucuaaacuaaguccagcuuuaaauaacaguguacuauuucaugugccauguaccuaauaucagaguauuuccuacucuucucuuguaucccuuauaauguuguucuuacucauuuaucuacaugccauaaucacucaauauauuguuaacauuguuacuuugaacaguuauuuguuagaucaguuuaagaguaaaaaauacauguuuuaauuuuaucuucauuuaauccuucucugacccucuuucuuuauguacaucaauguuguaaccuauauagcuguucuugcugaagaacugcuuuuaacauuucugcaaggcaugucuacugguaacaaauuccuuuaguuuuuguuuuaggaaguauuuauuucuccuucacuuuuaaaggauaauuucacuggauauagaugucuagguuaguguuuuuguuuuuauuuuuuucccuggcacuucaaguauuucguucccacucuuuucuugcuugcauaguuucugaugagaaauccaauguaauucuucuccuuguuucucuauaaaugaggaguuuuuuuucccuugucuuugguuuucugcaguuugaauaugauacuccaacuuauaaauuuuuuugauauuuccugcuugguuuucucugagcuuccugcuggguuuucucuggucagugguuuggugccuaucauuaauuuuggaaaauuccagccauuauuacuucaaauauuucuucugcuccuuucuuucccuucucauauugcaguuaugcaucuguuauagcuuuuuuauuuuaaaaaauaguuuuuggauauuguuucuuuuuuuucuuuauuuucuuuuuucaguuugggaacuuucagcugucauaucuuuaagcucacugauucuuuccaugguacauuacccaucuaucuugcauguugucuacauuuuccauuaguggccuuaaaauguuaauuguaguuauuuuacauucacuaucugcucguaucaaaaucuagaucauaucugagucuggcuugcuuugucuuuucacacuguuuuuucuugccuuauuuagcaugcauuccaguuuuuuguuucuuuuuucuggcuuucuuuuuuuuuuuuugguucccuucaauccaguuccuuuaacacuuaaaucucucugaggaaguuaacuaagaacuuuuucuaacuuucuuuccucacucucccaacaucugaucuuaagugaugaucuuuuccuuucauuuuauacuugugaggcagucaguaaguauauuccaaauuccacuuauucuccauucuucucucauuuuuuuuugguuagcucuaucuuuucuacauuguugcaccacacauuuauauucuguuauguaugacauucuuaucuucaugguuaguuuuaguucggugguuaaauauuuuuauuucauguaaccagauuuuaugcugaagcuucucaaaucauuucuucaguauguauaguuuauucauuaguaguuuucucagaaagaauggcucaaggaacgcuuuguuaacuaugccuuuaaacuugaaagauaguuugauuauauauacaguccuaggcucacauuuuuuguacuugauuuucuuaaaauuuuuuauuuuauuuugaguauaaaauaccuguuuauuguauuuggguaugaaauacagucacguguugcuuaacgacugggauguguucugagaagugucucuuuaggugguuucgucauuagugaacuauggaguguacuuacacaaacuuaaauaguauagcguacuccauuauauagcucuauuauaaucucauggggccagcaucuuacauguggucuguuauugacagaaacauaaugcgguucaugacuguuguagcuguuguaagguuuuuuugacaauaaacuuuucuuaauuuuaugagugacuugauauuucuaucuggaagcucaaggaaguuuuuaaaaaaagucuucaaagucugcauaguuuguacuaggaauauugaguugaauuucccuagcauaccguguauucuuugaguguguagauucaacuuuuauuuuagaaagauuugcuugaagcacaguuugauguaucugucuaguuccaauuauauauuuuuuugucgaguccaauuauguuacguuauagacaguugcugucuuuuguaucuguuucauuauuuucaucacuuuccaaccucuuuucccuuacugggcuauuuuagcgguaucuuuuuugggaggaacuuuuaaaauuuagucuguguuuuugaaagauacucuagacagauauuucaaacuguguauuuuuugggggaggauuuuuaaaaauuuaguccuuguuucugaaaaaaaaacucuucucacuuauauguaagucuuaucagcucuuccugucauucuggccauacuauuuuugagcuguuuuaauuuugaauuauugcuucuuaauaaaaguaaugauaauaaaaauauaaacuauuuucuuaauuucauuuaggucauuuugaaauaauuaacaauuuucaucuucguggccacauuuuucucaaguauuuuuaucuauuacaacaucuuagaguggauuuuuauuuuauuuucuauuguuuaaacaaguugguuuuccuguaguuuuagaaggaagaacuucuguaggaggaggggauagaccagugcaguuuuugagcuguguggcuccaggccgcauuugugaauuuuuuuuuuaauugcacuuuugagauguaguaaagcuuuucaccuuuauguuuuccagguauuuugcuuucugaauagaccccuuuaaauguauuuuacuguuguggaacuuucugagaucugugucacuuggaccuccugcccaccuagaaugugaaucuuaucucuccuggaggguucucauucuuuuugcuuugcuuaggucuauuucuguuucuugcaauuucuccagaaugggucucuguuuucaugaaaguaagagaguauuuguugguaggauacuucuacaguccucuuagaguguagaaucugccucucucaguuuuccaguuaucucugcauuuaccuauaucuuggagccugagaaggauguguuaucuaacuuuacuuaguucucagauuuucuuucccaucaccagcauuugaacuuguuuguuccuuugugaagaauagacuuuuucuuuauuuuuacaugagugguuccuucugauuagcauaauuaaaauauuuucagagaggugauuuuuuucuuuuuuuguaccaucccugggaaaaaaaaaaaacuguccugccgugucaccaccccguuuauuucuuuuguagcacuuaucacagucuguaauuaccauguuuacaauucuacuuguuuauuuucugcugcuugucauuugaauguuagccucacaacuggagauccuaucucauauaccaugguguucccagagccuaucacauugucuagcacaagacuaggacucaguaaauauuuguuugauaaguaacuccaacaaauaguaaaauccccuucuuacuaugcuguugucuuaaaauugggaaauacuugugagucuaaaccucugcaguauauguaagucuaagugauuugggagaaagcuaucauuuuuauaguauacucuuuauagcuggagauauuaaaaauugauuuaagaguugauccuuacugcauuuugaauuauagucuuuuaagaaaaaaacguuuguuuauuuauuuacauguacuuauccuuucaaaauacaauguucuuagauuuuaaaucagaaagccuugaaaaauuaucagcauucccccuucccacacauuuguagcuauaaucaaaaacuuucuagacuuccuguguguguagauaaagauauuucucgaauauugggagagaaugccccaaguuuuuaccaaacugauuaaucuuggguauuuaaauguguuccguaucagaauuuccuaauguauaaggacuuugguuuuuuuuuuuuuaaacauuuauuuuagguucagggcauacgugaagguuuuuacauaguuguguuaugggggcuuguuguacagauuguuucaucacccagguauuaagccuaguacccaguagugaucuuuucucuuuucugcucuucucauuccucccacccuccacccucaaguagucccaagugucuguuguuugcuucuuuguguucauaaguucucaugauuuagcucccacuuauaaaugagaacauacgguaguugugcugaggauaauagucuccagaugcauccauguucccacaaaagaaaugaucucguuuuuuuuaugguugcauaguauuccauggugcauauguaccacauuuucuuuaucuaaucugucacugguggacauuuagguugacuccaugucuuuacuguuguucauagugcugcagugaacauuugugugcaugugucuuuacgguacuuuacgguaaaaugauuucuauuccucuggguaccuccccaauaaugggauugcuggguugaauggcaguucuacuuuuagcuauuugaggaauugccauacugcuuuccacaaugguugaacuaauuuacacucccacuaacaguguguucccuuuucucuguaaccuuaaccccaucugucauuuuugacuuuaguaauagccauucugacuggugugagaugguaucucauugugguuuugauuugcauuucucuaaugaucggugauacugagauuuuucucauaugcuuguugguugucauguauguuuucuuucaaaagugucuguucauauccuuugccuacuuuuuaacuggguuuucucuuguaaauuuaaguuccuuauagaugcuguauauuagaccuuugucagauacauaguuugcaaauauuuucucccauucuguagguugucuguuuacucuguugauaguuucuuuugcugugcagaagcucuuaaguuuaauuagaucccacuugucaauuuuuguuuuuguugcaauuguuuuuuauuugucuugaaaucuuugccuguucuuacguccagggugguauugccuagguuaucuuccagcguuuuuauagcuuuggguuuuacauuuaagucuuuaaucuaucucgaguugauuuuuguauaugaugugaggaagggaguccagccucgaucuuuugcauauggcuagccaguuaccccaacaucauuuaugggaaggggagucuuuuccccauugcuuguuuucaucagcuuuguugaagaucagaugaucguagguauguggccuuuauuguauacuuuuuuugucugucucuuaaauuuuauguguguuuuuuuuuauguuuaaaaaauacuuugugauccccuuggccacagauaaccauucuuguucugauacgguauuaccccagcagaguguucacauguaguggaagcucuauuauaaugguuugauugauuguuauuacugacuuuuguguaggagcaagaguauacaugauacuucgaaugaagggugugaaagcucuucauagaaaugcagaauguuaacuuggccuucgugaguaguguuuccuagaauugugcaauucaacuccccugauuacagcugaaagaaauuugagacuaaagaauuaaaccuuucccuuuauacugcagauaaaauaauucaaguccugagagauuauguaauggauuaucuaaccaauuagugaccaagcuccaaaaucucaagauuucuaguugaaguugauuuuuuuucagauccauuuuaucauaugauucaacaaaaaggcaggcuuuagaaggauguuuuuaaacuaccaaaggaaaaacauccuuuuauacuuuuuaaaauacucugcuugacugacuuuucuucauauaaaaauuagagguggcuuuaaaguaucuaaaacuuccaauuuaaaguuggcggggcuuacugauaagcauccugaccagcccuuaucagaaaaaauguuaaaugcucaauuuuuugcccaauugcugcuguuauauuuaaguauucuuaagaguaguaauuuagggcugggugugguggcucaugccuguaaucccagcacuuugggaggcugaggcggcaagaucacuugaggucaggaguucgagacuagccuggccaacauggugaaauccccgucucuacuaaaaauacaaaaacuagccgggcaugguggcaggcaccuguaaucccagcuacucuggaggcugaggcaggagaauugcaugaaccugggagguggauguugcagugagcuaagauugcaccacugcacuccagccugggcgacagagugaaacuccaucucaaaacaaaacaagaguaguaauuugaaagguauauugcuaagcaagcuuaggguuuaagcauauguaaucaagaaagguuuuuaauuugcugacuugaauuaaaaccuaaaaugucaaauaaauuaucuucucauggugaauuguaaucguuuguuacugacauuuaauugguaguauauacagauauaguagauuuuaaaauaugcaaaaauaaagacauauaacuugggaaaaauuaaaacuguaucccauuuuucaguuacccauuuguguuucauuauaaauuuuuaaaguucucauagaagaauuuaauuacucauagucuugcuuuuguuuuguagucuuuguaugagaaacuuaaaauguuauucauuuuuauugcuuucaguuuucauccagcauugguaagaaugaaaauguacauuuuaauauuaaacuaaccugauggaaauagguagccauuuuagucuucagcccaacucuauuuucaauucuucuuaaccaguucucaguuauuauuugcauuuuaaauauuuuuaaauggcagauauuuaauuuaacucuaguuggcaaaucuuuauuauuugacucauauaguugauaccgaauugugucuuauaaaauguauuuucuauuuuucuagauguuaguauaaaugaaagucauggguaucuagaagaguguuguggucacaaucgcuuugguugccagaucagugacuccuggcaaguggaacuaaaaagccaguuucuauucuuucuuauucccucuagugcauggucucucaagauaccccuccuucuguucuacaucugcuucauuuuuauuaugcuacugacugccuuauuucucuuuuauuauucuuaccugguaucucuguucucuguuucauuaguucuguuuacuuauauauucuuugucuuagaauuuuauuucuauacuggcccaucccaucuccugucacaggagauagccagccaagauuagcagucauugaaauacucauaaguaaaaaucacauguacaaagcauauugccuaugauugcuccuucaguagaggcuguggaugggguauuccgcuuuuaaaaacaagggauguugaauugauaucaugauugacauauguaguauaagagguuaacaucucucacuuaguccugaaaauuaaaggaggauaggcuauauauaccacuagugaugguagauuguauaagucuuuggaaaguaauacaagggaggauaauaaugaauauguuuuauagaauacuacuauggcaauaggcucuauuaccacugcugaggggcugauguuagcagucacuacccuaaacuggauucuccuuugccuugcaggagaguggaaauggguggaggggagcaacaucauaggaggaagaauuaaaaacagucuagaucuuacuuuauguuuugaaauaagauccauuauuuaaaaauuuuaaaagacaaugagcuuuuauuaguuucuuugcugucuuuuucuaugucuuuaaaaugauggaaaaguagagccugauuugauuuucugaugguguguuaguacguucucacacuguuauaaagaacuaccugaggcugggugauuuaugaagaaaagaaguuuaacugacucacaggucuguaggcuugauaggaagcaugacugggaggccucaggaaacuuacagucauggcagaaggcaaaggggaagcaaacaccuucuucucauggcagcaggagagaaagagaaugaguggggaagugccacacacuuuuaaaacaucagaucuugugagaagucacucacuuugacaagaacagcaugggggaaauucgcccccccaugauccaaucaccuccuaacaaguaccuccuccaacauuuggaauuaaaauucaacaugagauuugggcggggacacagagucaaaccauaucagauugcaagucaguuugcuauaaaugcagaaaguuugcugucaugucaacuauuauuuucaacaauaacuuuuuacuguuuugauaaauaauauaugcuuauauauuauuuuauguaugaauaauaugacaaauaacaagaaaauaaguaaaaucucuuaaugguauuuaugccucauuuuuggcuaccauuuguacuuacuuuauauaauuugauguaaauuggaucauauaccugcuuaucuguauaaucacacacacacacacacacacacauaucuguauauaacagguuuuuaaaauaagaauagaaucauacaugcuucuuuguaucuugcauaguagaaaucccuuuaaguguuuuauaaugauaguauaaaguuccaugauguauguucuauaauuuauuugaucauuuccuugcuacuucaaaaaaugcggcaucaaacaucucuaucauauguccuuacguacuggagauuuuauuucugugggauggauuuugaaaugagaguucuaggugaaagaauauguacauuuuagauuuuaauaaauuuuacauguuuacuuuccauaaaggcuaggauaaugcacauguucaucuuuucucccuaauuuucugauaauuaggaauuaauuucaucaauuugauggguaaaaagggauaucuuacuauuuuaauuucuuuuuccaugacacagacaauacacagggauuuugagaaauuuuuuuuggucauaguuuauuggcuauuugaaugacucuucagugacuugcauucugcucauuuucaguucuguuguucaucuuauucuuaucaaguguaacagcauuuugcauacucuagauaugaauucuuuauuagucauaugaguugcagagaauuuuguccaaacuauuguuugucuccuguuuuucuucauggcacuuuuuauaacacaaaauuugaaaguuuuaauauaaucaaauaguuacuuuuuguuuuacagauuauguguuucuuggcaaaaagauacauauuggccccuacauuuuuccccuaggguuuuuauguauauguguauguuuagaucuuuaauugagauuacuuuuuguuguuguuguugagacagaguuuuggucuugcugcccaagcuggagugcgauugugugaucucggcucacugcaaccucugccucccggguucaagcaauucuccugccucagccucccagguagcugggauuacgggcacgugccaccaugccuggcuaauuuuuuguauuuuuaguauuaacgggguuucaccauguuagccaggcuggucucaaacuccugaccucaggugauccgccggcuucggccuuccaaaguguugggauuacaggcgugagccacggugcccagccaugagauuacuuuuguaugauauuagacaggaguuaacuuucuucugauggauauucaguugugcaucauuuaauaaaugaauuaucauuuccugcugaauuaaaauaucaccuuuaucugauacuaaauuuccaucuacacuggacucaguuucuggguuuguguuucucugagcuauuguuuuuuuccuauuccaguccuuucuguuuauaauuauggcggauuuaaaguguuuuuuuuuuuuuuaaggaaucuuuuuuaaagucuuuaauucuuacuuuuaaaaaguguuuuaaaagugauaagaugauuuccugucacuauucuuuuuuuuuuuuuuaguaaguuuucuuaacccuuuuuguauguuuauuuuuuccauacaaacuuuuuacauuguauacuccuuggguaaaauuucgcauaccucaaauaguuggcagucagcaaugcuugucuuauggguuuugguauaccacuuccuguguuagguuucugugggucaccaggagacaccccucagcaauuagauggcuucaacugacagggcaaguucuucucaccuuuagggcagguuacuucucuugaaggucuuagugggguagggagauagcagauugucacagcaauacuuaugcaguugaugccugacucuuagggagagaaguauucaaggaauuuaugguucuucugcuagggccaagcuuuuguaagauucuuaaagaucugagccuggccucuguaaccuggugggcucaggagaguuacuuaguuggcuuagugcugggacuggagaucagcaggaguaucuucaagcuucuaucuuuccaaacccccuaggcuaaccucacuccguuucuggucuguauuuuauuucuuuuuaauuuuccuuucaauuuaguaugagcuuuaaguuacagguaaucagugggauuaauguacuguauccuuuggugggucuacuuuaauuuuuuucuuuuuuguguuauuuauuuguucauaucauuaucagauauuuauuaaguaccuuguauauggcaacauuuaggccuaugaagauguaucacccaguccuugucuucugagcagcauuuugcaaaauuuuucuuuucuuucuucuuaaaauacugucuucacuuaguauuuacacuuucuagguuuucauuuucuuuaucuuuggcauucuucgguuucuuuugcuugauucuuuucuucuggaccuccuaaaugauggacucccagagcauaaucaguccuuaagcuuuucuucugcucuauuucauucccuaagucaucucacuuaauguugcggauuuaaauagcauugauacauugacaucucugaagaguauauuuuauucagcacugguauuuuccuugaauuucagccccagauagccaauugccauaucuaauaggcaugugaaaauucacaagaccaaaacauauugcaacuguuuggcccccuugauuuugcauuuagugguccaucugcucauuuuucagguuaugacacggcucucuuccucauguuauugaggccuguuucuccuauacuuuucuucauaguaacauuauucuuuaccacuacuuaccaauacuuuacauuauacuugacauauauaacauauauauauauauauacacuuaauuuuccagaugcugagagcuguuaaucuccuauuuuuagaaucaauuucuucucauauuuacugugguuuuugcuuuauuugauucauuacagcugacaaauuauguuaccaucgaauuucuuuuuuagagacagggucucucccuguugccuucuugauuuucugucucaaauaauuuagaagauaugugguacguuuuuauuucuaucuuuguuuaauuuuaaacuuuaaauaguauuaauuuuuuuucuuuuuaucaacuucagaaacauuauucuuuccuaggaacugugaaagaugaaggaacuaccucacuuccaugacaucuaacauuccccuccccauauuuauuauacuucaugauuuuugugguuccaauguaucauaguuauaauguauuagguuuuccuucaugcuuuauaacauguauaucagugugauuuuuaaaaauucuaguucuuuagcuuuuaauuguccuguagucuuuucaaacucaguucauaucuucaaucuucuguguuuucuaauucauuuuugggaaaaagcuuuuuuugugauaugaaaggaauuuguguuaauuuuagaaaauuugaaaaaacacaaaaaagcacaaagaaaaaaauuacuuguaaucucccuuugagaauuauauuaauaacuuaguauacguucuuugucuuuucucccuguuuaugaauguuauuacuuugcaacacuugauucuuuacauacacaguuaacuacuuuuccccuucacuuacuauguauugaacauuuuccuaugacauuaaagucaagcuguagaauacauaauaauuuacaugguauucuguacagacauguuauaauuuaauccuccauuguuaguuuauuuacagcuugcucuucuaaagugugcuuugaugaauguggauuaguuauauccccuagguuuuuuuuuuuuuuuuuuuagauaaaguucuaagaagugaaagaauucugaggcuuuagcauauggugauuaagagcauggacuuuguagacugacugccuuggguucaaauccuuacuuagcuguauacguuuaggcaauuaaucuuuucuuuuucuuuuucuuucuuuucuuucuuugcucccuucccuaccuucuuucuuuucuuuuuucuuuuaccuuuuuccugcaguauguuucaauuucuuaaauuuguauacuuccaagauaaugguuuauacauagaaaacauuuagaagagugucugggacucaaacacagucauugucgugguugucaucauuuuuauuuaaaggauguacauauuugaaauauuuuugcuaucgauuaaauuuuucuccugaaaaguuacauuaauuugcauuccuaucagcaaaauauaagaguaacauuuuaccagcccuggccaacaacugcuguuauaauuguaaaauguaguuauuuuugagggugugggacuaauuuuauagggacaauauauauguuuaucuuaaucuccaauuuuugaauauugauuuuggauuuuuuuuguccguuuucauaugggguauuuauauuuaagugcucuuuaaauauucaaauuuuaauuagcccaauguauuuuauuugccuuuauuuuuucuaguuggcuguuugccuguuaauuugauuuuuaguuguuuuauguguuuauguuuugccuuuguggaacauguguguaaaggcaguucuuuuccauacacugugcuuuuuaaaaaaauucauuaaucuauuuuugauaauaagucucuuuauuuguguugguauaaauaagucuauaauuauuaaguaccuucuguuugccaguauagaucuaacuuuuaaaaauagaauuuuuauugcagaauaauuuuagguuuauggaaaaguugcaaagauggcauaguuacuauauauguucuuuacgcaguuuucccuuguugcugacauccugcauuauuaccaugguacguuugucacaacuaagaugucaacauugguacacuacuauuaacuaaaugccacauuuuauuuggauuucacuaguuuucccacaaguauucuuucucugauccaagaucccacauuacauuuaguugucauguuuauuacucuccucuggucugugaguuucucagucuuuccuuguuuuuuauuauauugagaguuuggaggaguacuauucauuuguuucauugaccuuuccucugauguuuuccugcugguuaggcugggguuauuuguaucaauauagacucauggguauuuuaccacuuaaauuuuuuuagcauuggccugucauucucugugacccuuugacaugauccauacugcucccuucuucugccuuuuuuaaaaaacacuuuuuuucuuguguaagaugcucuagguuaaucuucuguauucccuuaccuggcucuggaaucagccauuucuccagcuacuccuguuuucuuuuauuggagagugguauguggaaacauaccauuguggaaauaccagggugcggugcuggguguguuuuuggguacuggugugucacugcuucuagucccccucaguggacagaauuagaaaauacuguuugugcacacacaccccuauaauuauuuauauuauauuacgguaaacacaaguuugcacugaugucacugauucuaauccaguaucacaggguuccuucugcccuccguccccuugccuaacuguaacaucccccuacaaaagugagaaaccuggcucccacauuuaccagccauuuacuuauuuguucaaccccaguauguauguaacauaggaauuaacccauauuccuugugaaaaacaacuuuaccaaaucaagcaguguuuauguauauagcucugcuugccuuuagccuuacaguuuccagugaaaaagcggucuucuaaaguuacuuauaucaguuccuuuuccacucacaguucugcuuuugaugguaugccuaaaagugcaucuuacuccaaagauggacuuuauauauguauaaaaaauauauauauucuauacgaugcauguuugauauauguaauauauaauguaacaauaugauugcaugcaauauaaugcaugcuacauguaauauguauauaugguauuuuauuuuuagguauuuuauugcuuuauuuuuacccugaagucuuuuuuuuuuuuuuuaaagacagagucuugcuauguugcccaagcuggaguugcuauucacagacaugauccaucauagcacacuguggccuugaacucugggccucaagucuuccuccaaguagcugagguuacagacgugugccacugcacccagcuauuuuuaccuuaaauucuuaaauauguaugucuaagguucauuuugucacuuaguguaaaguauuaauauaacuuuuuauuuuaaacaaaagugccuuaugaaaagucuugauuuuucucuguuguugaaaauaccaccuuugucauauuuuaaaaucuuauaucuacuagaagcuuucugugcuuuucuuacucuguuuuguuuucuauucuuauucaaguuccaaacauuacauaacuuuaugauaauuucagcaucugguagauuauuccuguuuuugccuauucauguucucuuaauuuuuuaauacuuucuuuauuccaggaacauuuuaguggacaaaccaaaugaccaaucuucaagauggucuucagagagcaacuauccuccccagguaagauuacauguaucccuuaaugcuguuuagaagucaccauuuaaauaaacacucaauugauacuaguuaucuggaaucuacuaauaguuuauucucuuuuugagauugugagguaaauuuuuauucucucuauuuuugcuuguuuauuaaauuuuggaagaauuuuuaucucauaggcaaaugcagugugagauuugaugaaacauggacuuuuacuucugucuaccagaacaguuacgcucaaguuauucuguaaauguuuaaggaaauguuaguaaauugaacucugacucaaugacuaucuuauggggaaaauaaacuuaaauaguuuauuuuauuauaauauuauuauacuuaauauuaaaauaauauuuaaauggcaucaggaccaugugcuaaauuucuuuucccuggcaaguagugucugggguugacugaauuuaaaaucagucuuucaguuauaugcguucagcauuaauauuuauaauguauuaggcacacguauguccauauccuugaagaaauuaaugcucugcuagguaaagcaaauggguaaauaauacuuacuuuauuuuuuaauuguaguauaauucauggaaauauauauauauauauauauauauauauauauauauauauguaugauguauguauuuuuuuuucucuuugccuaccuauuuggauccccugguguuuacauguuuuauugcaaaagacaugucuaaagaauauauauuuauaauuuuugggagccgcaguggcucaggccuguugucuggugcauaaggaggcgaggcuaggcguucgaggcuagccugggcaacacagaaaccuuugaucuauguuaaaaaaaaaaaaaaaaaauggcugggcgcgguggcucaugcguguaaucccagcacuuugggaggccgaggagggcagaucacaaggucaggagauugagaccauccuggccaacaugguaaaaccuugucuccacuaaaaauacaaaaauuagcugggugugguggcacacgccuauagucccagcuacucgggaggcugaggcaggagaaucguuugaacccaggaggcagagguuucagugagccaaaauugcacaacugcacucuagccuggugacagagugagacucugucucaaaaaaaaaaaaaaagaauauauauuuauaauuuuuauauauaauguaaagaauaagacaaauaaccuguuuauucaucagccauguuuagaaauggaaagugacugcuaucuuuugaagccuccuuugagcccccucuuauaucuuuccucuaaccccuccccaguaacuauaauugauguuuuauuaagcauuuuaaaauaauauuccauagauauagcauauaaauauuuuaugauuuaauuuuuuuggcuuugacuuuauaaaaauaaaauauaaauugauucagucauuuauaaauuuucugugacuagcuguuuuuuaacaugauguuuauuaauaucguuauauguaauuguaguuuguucauuuucacuaccauauaguauuccuguguauaaauaugccaaaauguauuuauccauuuugcugaugauaggcauuuaggcuuuuuacaguucuucgcuauuaugauacaagcugcugugaacauucuuauauguugucuccugguacacauguguaagaguuucuuuaagguauacauaccuuggaguagaauuguugaauuauaggguagguauauguguauugaacuuuaucagguaacagaagacuguuuuacaaaguaguuguagaauuuauccucuuaaugguuguuuauggaaguugcuguuggaucauguucuccucaucacuucuauggguggauuuuauauuuugccagucuaguggauuuuucauuuuaacucauugugguuauaauuugcuuuuuccuauuuacauuaaaaucucuuugcauauguuaauggacuuacauuguguuuuuaaucacgcuuuucuugauucacuuuuucauuuuacuuaauuuuagugcucaaauuuugguauguuaguguuuuucauuugauuauuuuuauuucuuauuaaugaucuuuucugaaaaaaggaaaauucagugaucauaacugaaacuaugauaaccuuauuauuuugaaauugucuuuauuuguuauuggacuauauuuugaaggcaguagaauuuaauacuuuucuuaacuuuuuuguuugcuuauucauucauuaaaaaauuauuuaguaagcaucuauggagugccaaacuuuagguauuugaauacuguagggaauuaaauauugucuccucuugaugagcgacggguauuacaucagauacccugaaacauuucaauaugauaaguccuauaguagaaguuaucugaaguuuuuguaaugaagaaggacuaauuugucaugaaaauaaauaccaugcaaucuaguuuucuucauuguaguuauuacucaaauauaacugggguuuucuguggccagucucaagggacaacauuuuugccagaaaagaaaaaauaaaauugaaagcaauuucaauguuuacuuaguuguaugagagacugccauguuggauggaauggguauaguuuuauuuuuuauuuguuuauuuauuuuuuugagaccgaauuuugcucuugucauccaggcuggagugcaguggcguaaucuuggcucacugcagccuccaccuccugggcucaagugauucuccugccucagccucccgaguagcugggauuauaggcgugcaccaccacgcccagcuaauuuuuguauuuuuaguagauacuggguuucaccauguuggucaggcuggccuugaauuccugaccucaggugauccgcccaccuuggccacccaaagugcugggcuuacaggcgugaaccaucaugccuggccagcauggguauaguuuucauguauaguuauguagcaaagagucuugcacuucuagugguuguaagcuauaauauuucuuucccacucuugaucugaaaguucccaaaugcacuggauaaaaaauagauauauccacggccggacgugguggcucaugccuguaauccuaccacuuugggaggccaagacggguggaucacuugugcucaggaguuugagaucagucugggcaacauggugaaacccugucuguacaaaaaauacaaaaaguagucgggcaugguagcgugugccuguaguccgagauacucaggaggcugaguugggaggauugcuugaacccaggaggucaaggcugcagugagucgagaucaugccacugcacuccagccugggugacagagugagagacugucucaaaaaagaaaaaauacacgcacgugugcacacacacgcacgcaaagcugggacuuuuuuuuuuuuuuuuuggaagcuggaaccuuaaagcaauucauucucaggauaagaaugaaacagaagaaguccccaccuccuagggaccguggaaagaauugcauugacacucaguagaggaagggaaaaugaggaagaaaacucgucucugagagguuauagcuuauguauugguuuuuguucacauuugguagucagauucucauuacuugacuauccaugaaaccuugugguaugauuuuaguuuaaagugauuguggaugaauaguacauuuaagguucucagcagaagcaaaugcagaucuucucugaaaauaguuaccuuuauucuaggccucaggcauucuccacaaaucauuauuagaggaaaauugagcaguacacacucaaagauaacuaaguauauagcagaaaguaagauacuuuaagaacuagcagaacaaauggcagaaccccuuccagaauuuuagauauuagaauuaaaauuacugaaagauacuggaguuaagucaacuacuuauauuuaaagaaauaaaagaaauuggacacuaaaaagugauguggcagauuugaaaaagaaccaaauaaaacuucuauaaaugaaaaauauaauaauaaaagucaguuuugacaagauuuuccacuaagcacagauagaaaagaugaaauagaagucaaauuuuaaaaaauauuuuugaagguaguauauugaaaauaagguaguaaagagugaugggaaugaauaagaccuacuauuugauagcacaauaggcugacuguagucaauaauaacuauauauuuuuaaguaacguaaggaauguaguuggauuguuuguaacuugaaggauaaauguuugagguuagggguaccccauucuccacgaugugcguauuucacauugcaucccuguaucaaaacaucucauguacccuguaaauauauacaccuacugugugcccacaaaauuuuuuuucaaaagugauggggccaagauucagaagacuaugggaaucuaaaaagaacuacuuuggggccacuuuucuacugaguagccuaaagaaguucuaagagauuaagaagcugaaauagcaccuuugacaaaccccuggagccagggaguuauagauuagaagcuagaaucuggggugugguagggugguagacuccucuugcucugggcugaagacccugaagcuaugucugaagagugagcgugaaccagaaauaaucuggcccucacagggagugaaguccaguuucauaucaucccgguacuugaaacuggauuaaaauaaucaggaauugguaguaucccuagcaauagaccuacaguagaagauauacuuuuuuaggaagcugauacccuaggcauguaguuacuuuuaguuuuucauauuuggugucuaucaaaauagagggauuuacagauaauaggaguuucagauacaagucuuaaaauaagugcccuugcuaugugaaaggaaaaaaggagaugaaaauuaauauugaaaauuuuggcaaagaacugaaaacuguauuaaaaaauaccaacaaaaaaugaaaaauacaauacccaaaaugcaaauugcacuuaugagaauaaaauaagaauguaugcaaaagcauuuucugaaauuuaguauacuuuauguaaaguagcaguauuauuauaggcagguauugcuaagaaaauaauuguugccaguaauauaauauugcagaugcaaaaaguuauucacuuuuuaguuuauucuaauaagcuguuaugugaccugcuuguuucaaaucacuuaagaggauacucaugcuguauaaauuaguuuuauuuaguuuugaauaaggagaaaccuuauuucacuaaauguugauguguuuuugaauucuucccauaaucauacgguaauugcaaggauuaggauacauguaguagcuacuuugcugcccuuaaacuauggcaaguauuuugguuucauauacaguugauucugguuauucacaguaguuauguccuauaaaguagucaugaacagugauuuagcaaauacugaaccauugcuccuagaaaaauacaggguuagguuccugugagucuuugguuaaauauuuucaucagcuaaucaauguauaaucuugucuuauguauguuucuguuuaaagaaaccuuaauauaaguauuuuugauucauuaacauugaauucacagccaacaguacuauaacucauaucauaaugaguuuaucuaacacauguauuuucuccauaaggcauaucauuuacuuaaacuacuuuggaagaagcuuauaauugcaguaaaggaguuaugaucuaacccuuauuaugucaauuaaaaagacauuuguaacugccuguacauuuuaaccaacccuagagaguuuucaccagucaucuugaaagacauguuuuccaugacaguaucaguaacuacuguaaccacauauaugaugacagggaagggugauauuauaucuuuaaagcauuuaugggauuuucauucaugcuacauuuacucuaccagcacagaugauccagaauuaacagcaauguuuucucauuaaggucucaaaauauugcccccaucacugugaaaaugacuuuaauguuuuuguuuauacaaauuacaaauacuaaaagugagaaucaaaaaggagauaaaagcauaagaaaucuaaaauaaauuagaaaucagcugaauuccaucauccugaccucaucacuaccaccaccaccaccaccacugccaucauuuugaagaugauucagcuuaacucugugcauacacucacacagacacauaauuuacguaacauguugguuuuauaaaugggaauaacuuuuuaaaagaaaauaauuguuuucuuuuuuuuguccucucaucuccuucucucuaguaaccaaugcuaacaaucagguuugugcccauucauaucuuuauauggguucauugcaucaaauacuaauuuaaacauguacaugcauacaucuguauguacucacaaacauacuggcaagcgcaagugucauuauucagguaauaauaguaggaucuuguuaccuacuugauuucuguuguaugaauaucucacaguuuguuuauccauauaccuguuaaugaacauugaaucguuuuccaauuuuuggcuauuacaaagaugugcuaaaaauuaauacagaagugccuggguaugguggcucgugccuguaaucccagcacuuugggaggucgaggcaggcagaucacuugaggccaggaguucgagaccagccuggccaacauggcgaaaccccauauccauaaaauuacaaaaaauuagccaggcgugguggcucaugccuguaaucucagcuauuugggaggcugaggcacaagaaucacuugaaccugggaggcggagguugcagugagccaggaucuugccacugcacuccagccagggcgacagacaaggcgagaaucuuucucccaaaaaaaaaacaaaauuaauauacaagucuuugugguuuuaauuugcauuuuuaaaaugauuaaugauguuaccauuuuuuguaugcuuguugccuucuugacuguuuucuggugaagugucuguucaaaagguuugucguuuuaaaauuuguuguuauuguucaguuuugagaguucuguguauguuuuguauuuaaguucuuuaucagauuuauauaugauuugcaaauauuuucuuugcaucugugguuuccccuuccuguucuccccacucacugccccagccuuccuucuguuccaauauuagagggaaucaucauuaagcaugaugcuuagcuauagauauuuuauuuuauuuuauuuuauuuuagagacagggucuuacugugucucccaggcuggagugcaguggugcgaucuuggcucacugcaagcuccgccccauagguucaugccauucuccugucucagccucccgaguagcugggacuacaggugcccaccaccacgcccggcuaauuuuuuguauuuuuaguagagacaggguuucaccguguuagcuaggauggucucgaucucuugaccucgugaucgacccuccuuggccucccaaaguucugggauuacaggcaugagccaccacacccggccagcuacggauauuuuauauauguccuguguuucuuugagaaaauuuccuccuguuugaaguuuucugagaauuucuaauccugaauggauauugaauuuuguugcuauuguuccacaccuuaaaaccuuuuuauguuucucuacuuguccuagaacagaguccaaauuucuuaauauggucacaaauuacaccuccuuccagcagaaggugcagucucuucuaccucaugagucuugguuggucuugugauuuucuuugaccaacagaaaagucuaagaaagugauauugcaacuucuaagcaaggccuguagaagcuuagagauaaaugugcuugaggaaagccuauuuagcuucuuugagguugaaagcccaaucccaauuaaccccagccuucccauuccccacuccaguuaagcccaguccccuagccaauccaucagcuuaauacaacuacaugaaugaauccagcagcuaccaauggaaaagcugucuagcaaacccacagaaucaugagaaaucaugaaccacuguuguuuuaagacacuggagugauuuauuacauaaccucagauauacauagauauaaaaucuggacuuuucuagucucauuuuuguacuuccuguuucuuugccaguucuuuccaucacaguaaaugauaucaccacuuacccuguuauugaagucagaaacuaugucaucauccuuaaugccucccucuuuuuccccugcauccaaucugucaccaaaucccaucaauuguuucuccaaaaugugugucaaaacugucuacuguuguccaucuccacgcuauuuuaguccaagucuccuucaucucaccucuuuccugaguuuauugugacagcauccuaacuggugugccaguucuuuuaauccgcucucuguaaugcacauugugugcauauguguguguaauguuaaucagaucauagcuuuuuguugugcuuaauagaucccauugaauuuauaauucaaacuucauguaauugcacaaacugcaugaucuggugacugccuccucuucauuuucaacacauaccauuuucugcccugccuauuaggcugcaaccacacuggcauuuuaacagcaguaccuagaacuaauuuucauaagcauucacuacuuuuuuuuuuuuugccuggcuggcucuguguaguagauugaauggucccuccccccacccccaccccuaccaagauaugugacaucucagaaugugaccuuauuuggaauaaaguguuaguaaauguaauuaagguagggaucucgaggugagagcaucuuugauuaggguggccuauaaauccaaugacaaguguccuuacuagacacagaaaagacacagauacagggaagaaagccaugugaagauggguggcagagauaggaguuacacugucacaagccagaaaaaaaaucaagagccaccagauacuggaagaggcaaagaaggauccuuucugagguccuuugaagggagcaugguacugcugacacuguaguuuaagacuucaggccuccagaacuaugagaaaauaaauuucuguuguuuuaaagccaucgauuuguuauaauuuguuauggaaacccaaggaaacuaauacacccuauaguacaccuauaguuagcuguguaacuauauuucuucaucuguaaauugaggaugaagagaguaaccuguguucauauauuccucccacuacugcuacuacugugaaugagcuaaugcauguaaaagucucagcaaugugccaaauaagaaguuagugcucacaaaauguuagcguuauuuucauugccauucuuaacaccaccagcuuaauucuuuuuuuauugagguaaaaucacacauaauauaaaguuagccauuuuaaaguauauaauucagugacauuuagugcauuuacagaauugagcaacuaucaccuccaucuaguuccaaaauauuuucauuguccacaaagaaacuucauauacccaguaaggaguaucuccuuuucgaucucagcccaguuuuugacaaccacuaaucugcuuuaugccucuaugcauuuacuuguucuggguaagucagacuggcuuuuguaucugacuuuuuucacuuaguauguuuuugagguuaauccagguuguagugugugucagugugcauuccuucauauggcggaauacuacauugcacagaaauacuguaauuuggccauucaucagucgacggacauuuggguuguuuccaccuuuuggcuauugugaacaguaccccugugaacauucauguacgacuguuuguuuguauaccuuuuuuuuuuuuccucauuucauuuggguuuauaccuaggaguggacauucuuggucguguaguaauucuguuuaacuuuuugaggcacugccaaaugauuuuccacaguauguguaccguuuuacauuccugccagcaaugcaugagaguuccaguuucuuuacaucuuugucaacacuuacgguuuugcauuuuaaaauuauuauuauuauugccaucuuaguggaugugaaaugguauuuugugauuuggauuuacauuuuccugaugacuaaugauguuaagcaucuuuucaugugccuguuggccauuuguuuacuuucuuuggagaaagggcuauucagguccuuuaucuguuuuuaaauuggguuguuugucuuuuuguuguuaaauuguaggggcauuuuuaauauauuccagauaccagacucuuaucagauauaugauuugcaaauauuuucucccauucuauagggugucuuuucacuuucuugauaguauccuuugauacuaaaauuuuaguuuugaugaaauccaauuuauuuuauuuuguuuguacuuuugcugucauaucuaagaauccggugccaaauccagagucaugaagauuugcccguaguuuuugucuaagauguuuaaaguuuuagcucuuacauuuaggucuucagucuuuuuuuuuuuuuuuuugagcuagagucuuacucuguuacucaagcuagagugcaauggcgugaucuuggcucacugcaaccuccaucucuaggguucaagcaauucuccugccucagccuccugaguagcuaggauuacaggcgaccgccaccaugccuggcuaauuuuuguauuuuuaguaaaaacgggguuucaccauguuggccaggccggucucaaaccccugaccuugugauccgcccaccucggccucccaaagugcugggauuacaggugugagccaccgcacccggccaggucuucaguccuaaaggauugauguuggaucaguuuuuauccauuuugaguugauuuuugugugugauaagaggcaggaccagcaaguuuauucuuaaccgucuuuaucaccuauauuauccaauaucgugaagcaugacgucucuccaacaaaacaucugauugguuuuucuaaauagcuuuuccaacauguguucaaggagugguaauuuucuucuuaauuuuuauaauagagaacagucugcgugauguucucuauuuaauugaucccguuuuauccaauguguaauaggaaaaugagcuacauuagacguaucuagaguagauuuggguuucaaauuuguaaacuuggcaggguugauuaguaaaucuuugcuucuacaucuaaaaauuuuagugccgcuuucaaacauugguuuaguuauugaaguagaguccauagaaauauguaauuguuauuuuuguauucuaaucuuguuuuauuugguuuugcauaguuugguuauaucuuuuauugaauacuguucuuugauuagaaguuaucucacuaguucuuuuuuuccucccuucaccuacaguguuggggauaauguaguuuuugggaucuacuggcgugaaaagugguucuggugggauaaccuuuauaaggcuguuauguacuauucuauagcuuuaaaaaaaucugcuaguacaggauggacaaggauggaccuuauacauucuucuguuaacuggcaauaguuuuaaaguugucuaacauuuguuuuaaacagaagaggauauaauuuggucguuucuuuuuuuaguacuugauucuaaagcucgaaaggccugcuauaguucagaauaucacauuuggaaaauaugagaaaacucauguuugcaauuugaagaaauuuaaagucuuugguggaaugaaugaagaaaauaugacagagcuguuguccaggugaguuaugguuauguugaagagagcugucuucuaaacaaaacguagucuuagucuuuuuguagcuaaucugcaugguuugauuuuucuuucaaaggagaaaagaguauuccuucuauucuaucccuaaugccuuaguuuaauacuguggcuugaguuagcuuucuuuuuuauuuuuauuuuuuaaccaacagacccuaguuaauauuuuuaccaaagaagaaacaaacuuuuuuguuucauccuuuuuuaacuguauuuuugagcuguuaaugacuucagaaauauuuucagcuuuaaugaaauuuuuugcuauaaucuuugcuguaaaaaaaaauacaggcucuauccaaaacacuaagauuaauugcccuaauccagaagcaauauucuagugguuuacuguaaguuggagacuagaaagaggaauguuuuauaaauugaaagaugcgugacuacgccaagcacagugccugucacuuggaaggagcucaguaaauuugaguuuuaauaauauuugaccaccgggaaugaagguguuaauuugcugcccagcaaaugaaaaaucagauagcuaauggaauggacaaaugaaaccauggagauuuagaauauauuugugauggcugggugugguggcucaugccuguaaucccagaacuuugggaggcugaggcagguggaucacgaggucaggaguucaagaccagccuggccagcacagugaaacccugucucuaauaaaaaugcaaagauuagcuggacaugguagcggacgacuguagucccaucuacuugggaggcugaggcaggagaaucacuugaaccugggagucagagguugcagugagccaagaucgcaccacugcacuccagcuggggugaaacagugagacucugucucaaaaacaaaaacaaaaacaaaaacaauauauuugugacaugguauggcccauuaacauaauauuuuauauaagcaaauacucuauacuguauuuaagucaugaaaguauuucaggaaauguaaagcaaccugagggugagugacuuucccauaaaucauugugucaguccuaguuguuuaaguagagaggugauauccauuuauuuuuauuuaggauaaagcagaugcuauuaagccaacagaguaagguuggcuuugaaaauuuguugaacuauaaaagaaacauuggcaucucagucagaauuaaauaacuaaauucuuuggcguauucuaauaugugguuuuaaauugucagauuugacugugaauuauuuuugaauuucauucuuaccguugaaaauuuuauguuauauucaguuauccauucaggacacuaggcccugucacacauuuuuaaacaccguagcuacauucuuuauaauacugaacauuuuucauuaauccucguauaauuaagagaauccaguuauaaugcuguugauuugaauguaccgguuuugaccuauaugcccauguucaacuacuuguuuauauugucuuggucauaauauuuugagcaugaguuuaaacuuaaaaccugagugugcauuaauucguguucuagugcauuuacuaaauuaugaagucagauuuaauagccuuauuuuuuucccacaguggcuuaaagaaugauuauaacaaagaaacauucaccuugaagcauaaaauugaugaacagauguucccuugucgauucauuaaaauagguaagauuuuagcauucugaaauagaaacaaauucuugauaucaucagucagcaaacuauagcccauagaccaaauccugcaggccucuuguuuuuuuaaauacaauuuuaugggaauauugcugcgcugguuuguuuacauauugucuguaucugcuuuugugcuacaaaaguagacuugaguaguugcaagagaccacagagccccuuaaauuuacucuuugguccuuuacaggagaaguuugcugacuucugcuuuauauaaauucauuacuaaguggcaguuauuucaaguggaaucuuuuccaaauguuuucucauuugaaaguuuucuuagauuuuaugggaucuagugauuugauugccuuaauuuuauggaagguuuaucacuuauacuaaaacaauaauauucuaaaaccaaauacugauaaaauccuuaaggcaguauauuaugguuauuaucaguuguguucuuuuauuuuauuuauuuauuuuuuuuaguuaaaugcuggucaaacccauuaaauugauuuaaugacccaucgauagguugcaaaucacuguuugaaaaauauuaccuuaaggcauguauuuauuuagcaaguauuuuagcuuaagaaaguauuuauaaugcauccucaaaauuaguauuuuucaggugauuuuguuuccuauaggauuuauuauuuagaagguagggaaauugagcaauuaaauccuggcuaacauggugaaaccccaucucuacuaaaaauacaaaaaaaaauuuagcugggcguggugguaggcgccuguagucccaguuacucgggaagcugaggugggagaaugcugugaacccaggaggcagaguuugcagugagccaagaucaugccacugcacuccagccugggagacagagcgagacuccaucuccaaaaaaaaaaccaaaaaaaaaauacuucuaauuuauaaccauguugcauacuuuugaaaauauuauauugauauggggauuaaagugaauuagauacuuugaagaauaauaauaaaagccagaguccacauuuugauuugggagaauaauuacucuuuuggagcaaacauagucauuguuugccaaucuaucaagaguugcugccauuuuguuuugugacucaaacaguucuguagggcaaaagaauauuugaggucuuaagaaaaacugcuuauauacagaaacuguuuuuggaacaauuggauuccaguaugucacuuuguaguaauuauaguuucuguuguuauaauaaauacuuauaaauuaaaaccuauauucuguuuucuuauaagaauuuaugagcaagcaaauuuuaaaaauaaauuuaacuuucgguuauuuacuucuuuugcacuggguaauguuuucaucaguauuuagaguuaucaguuccuaaagaccuuugcauagcuuuaacaauuuuaugauuuuauguugcaaguauacaagcaguggaaauuggaaccuuuuccagcccugucagccuuuuuuccccuuucuuuucuuuuuugcugaguauuugaauaugugcacuuaaaaaauuuccccccagcuuuacuaagguauaauugacaaauaauaauuauauauauuuaugguuuacaaugugauguuuugacauaugaauacauugugaaauuauuaaaucaagcuaauuaacauaucccucaccucacauacuuaacauuuuuuuauggugagaacauuuaagaucuacucucugagcaauuuucaguuauuacuauagucaccaugcuguacaguagaucuccagaacuuauucuuccugcuugacugaaacuuuuuacccuuucaccaacagccacgcauuucucucaucaccuuuuuaauuauagggcauaaugaugucuuuuacuugaucuaggguuaguuuaaugguauuuaggcaaaauguuaauuggagcuuuccaaauaauaguagacacuuauuagcccauuuucuauuuaggauauuaauauauagauaacuuaguaugucuuacuuuucucuuaaaauauguuaauaccggucagcaguguauuugcuucccaacccuuucccaagcauucucuuaagaacuuuuuuuuuuaaguaauauaaggaaaauauggaacuaaaaggccguauguuaggucauauuuuuaguuugucauauuuucuucaaaaguuauuccaguaaaggacuugaaugauguauagcucucuuuugauguuaguuuagcacagacguuuauuucauuuagguaaaucguuagaauuugacuuaaaaaaagccuuugaguauuuuacaucuguguucuauagugacauguuugaaagaucuugcuuuauuuaaaaaacaaguuaaugcuuaaacagcaaaauuucucaauuuagucagccuucaauuauucacaguaauggaggggaacagaagcaaggcuaacacaauggcagauaaucuccaaauuguuuauugacauguaacuauaauaauuuucauuuauaaugaauguagcuuauuaagcaaauugaaguaaguuuggucauaaauuguuaacaaggaaaauagcccacauuucuacuguguggcagggguuaacuuuuaagaucuguuguggauaauucagaguaccaguaaagcugaacugaugucauuggacugccuuccuucaggaaaguuuuacuuuccuuucuuaaguuaccuuuuguauaaaaugaggauguuaaugcuuuuucugucuaaugguaggauagguagcuauauuggauauuuucuugaauucuguuccaguuuguggaucugugguuuuaauuuaagaguacauuuauggaagaaaugauugcauuuuggauaucucuuuugcacauuuucguacuuauauuuuuaaaguuuguguuuacaugccuucuuacauguaguauucuagggacuuugaugggacuuaguguagaaggacaguuggccuuagaaagaagcuugguuuuagauaagaccuagaggugaaaggaaaauuuaguaacagaggugaguuauuaauugggagacuggauuccagagggcaaguuaaaguuugggaagggaaagcucagcaggagauuagaucagaggaaaguaaacauaaaauggguugaggguauugguuacagauggcucaaaggguuuacauucugauuuauagccacaauaacagcuguaugaggaaaucagggguaggugagggcaaaaagagguacagggucuuggaaggauucagggggagucuugguuuuugguaaauggagagauguggauuuuuguaaaggagucagcugcagccuggaugauuguggagacuucagagagcggcuuuaacucuggcuggaugcagcaugaaaucugagcaugaagucuggguauuaguuccaggaagcccuuuaggagagcauguggaaaagugacauuuuagaaguauacuauuaagaggaaaauuaauauaauaauaauagauaauaacagcuaacauuuauugaacacuuaguaugugccaguuacugugcuaaguauacuuaugucauuaaaucuguaguagaauaguagaugcacucuuucagaauaguuaaucuugaauuuuuaggaucucucagaaccucuuuuuuuuuuuuuuuuugggagguggaguuucacucuuguugccuaggcuggagugcaauggcacaaucucggcucaccacaacuuccugccuccuggguucaagcgauucuccugccucagccuccuaaguagccgugauuacaggcaugcgccaccaugcccggcuaauuuuguauuuuuaguagagacgggguuucuccauguuggucagacuggucuugaacucccgaccugaggcgauccacccgccuuggccucccaaagugcugggauuacaggcgugagccacugcgccuggccuaauuuuuuuuuuuuuuuuaagaggcagagucuugcucuguugcucagguggcacaauuagagcucagugcaaccuccaguuccugggcucaagccauguuccggccucagccucccuaguagcacaccaccacaccuggcuaauuuuaaaaacaauuuuuuuguagaaacugagucuugcugucuugcccaggcuggccauuuuaugaaaaaaggugacacagggauguugauuauauucaugucugauuguccaauggggaaaacugaugacugaauccuagaauacaaacugcuagccuugggauauguauuaggaguuucuaauucuuuuauuugaugagggaggcaucuuuuaucagggaacaaagaacacgugccuggagcuuuaauucacuuuuagauuucuuaguguucuaauaugcauuauuaguauuguuaaugcuaccaaaaaucacuggcguuugaagugaguggacaucauucugcucauuuuuuacauacccuuuuagucuguugaaaauuaauuauauuguuuauucaucuguaauauauaugcccauuggcaagauaacuucaugauuuaccuccuuccucuaaagguauucuuuaaagguauuaaaaauuauaacuaauuuuauucuagaaauauuucuauuggaccauuggguaacagauuaaauuucacugcaaguguuuuaaaagguuuuuguuuuguuuuguuuuguuuuguuuuuuaagagacagggucuuucucgguuaccuaggcuagaauuuaguaguguggucauagcucacuguaacacugaacuccugggcucaagugauccuucaucuggccucccaaguagccaggacuacaggcacauacuaucaugcccagcugauuuuuaauuuuuuuuuguagagauagggucucacuauauuuccaggcuggucuugaacuccugggcucaaaugauccucuugcuucugccucccaaaguguugggauuacagacaugagccacugcaccaggaccaauaaaugaauucuuaaugagacuuggaccuggaaaucucuaauauuuuaugucuggugacauauauagacuauauucuuggugcuuuuaguuuagaaucauuauuuuauucugacucuuauacuacuagaugguuauugcuaugugauuuaguagauaaacuuuuaaaugacacugcuacauaaagaaacacuaaaacaauaaagauaauuuaauauuuguuguuaaaaaaaaacuuuuugaaauguguguuguuuacauacauaaacagaaaggcauauuaaauaucccagcauuccuucauacauccuuauggcugguugcuacugccuguguuuuuauucacacagcuuccuuuauaucagugguccccaaccuuuuugacaccagcgaccaguuuuguggaagacaguuuuucuguggacccagaaguuggggcaggguaugguggagagaugguuuugggaugaaacuuuuccaucucagaucaucaagcauuagauucucauaaggagugcacaacuuagaucccuuguauuugcaguucaugauagaguuugcaguccuuugagaaucuaaugccaacgcugaucugacaggaggcagagcccaggcaguaaugcucccuuaacacacugcgcaccuccugccaugcgucuggguuccuaacaggccagggaccuguacagguuugggccuggggguuugggaccccuguuuuagaugacaaaaauauauaaaaguaucauaccccauacauuuuccuuauucagucggauauuggaaaucauuacgccugguaucagcuauucuggauauucuauuuugaugcuucaucaaaacucuacaaauguuaguuucuuaaagauaguugcauuauugauucugaaacugcaucagugaaucuguuguuacauuaaaauucacuggucuaucuuggacuuuuuacccaguggucugucuuggacuuuuuacccaggugugauuuuguaacauucauugguuauuuagaaaauaugguucacugaauuacacagaucucccaaauguugaaacacuucauuauguaauauuuuaaaaaucacauuuauuaauaucacaucuaaucucauuuaaaaaaaucuaaguguugggaaucaguuaagcucacagugguggguacuuaucuuccaaaauucuaauuuuucucuugaaagcuugguuuuuauccuugacagcaaauaucguuaaguauuuuccuugaaauaacauguaaauguuuggcaaauacccaaaucugaauaaucauagguugucuguuuuucuuucaagaauaaaauggcauuccaugaaaaauaaauugauuuuuaaacucacaacuuaaauaauuguacagguccuuuccuugagauaaccauugugguuugguacacaacaaaaaugcuuuauaugcaaaucucauuuugucacacaggauacuagacagauguguacuugaugggaauuuaauaaaauuaauuuuucugugccauugguaaaaauuauuuuuauuuuauuuuauuuuauuuuauuuuauuuuauuuuauuuuauuuuacugccaguguaugguggugaggcauacagugcaccuuguacuuacugagcacuaauaguacuuuuuggugccauuaguuugguaccaaggugcuagcaguuuuacacaccauugcuuuuguaccauuagugcaauguugcuauuauuaaaaggcuagaaaaguguuuauuauguuauuuugaaaaauaguuguuuugaaaaauaacuaguguuguuauuaaaaaaaaaaguaguuuugacuacgugggaccucuggaaagaccauugggauuuugauugacaugauguuaaauuuauaauuaauuggagagagcuacacauuuacaauauugaguuuuccuauauaggaacauaguauguucuuucauuuauucaauuauucacuaaaauuuuauauuuucuuauaaauauugcguauuuuaaguuuauucugaaguauuuucagcuuuuugccauuauaaauaggacuuuuuugagguauauuuucuaauugguuauuguagguauaggaaaaguugauuuuuguguguuuaccuuguuuacaaauaaaaaguuuuucaauugaauauauauauauauuuuuuuccacugagacacagucuuauucugucgcccaggcuggaguacaguggugucauggcagcucacugcaaccuccaccuccuggguucaagugauucucuugccacagccucccaaguagcugggauuauaggcgcacgccaccaugacuggcuauuuuuucuauuuuuaguggagacagaguuucacuguguuugccaggcugguuuugaauuccuggccucaagugauccucuugccacggccucccaaagugcugggauuacaggcuugagcuacugcuccuggcucucuugaauuuuuuuagguagacaggucaucuuuaaauuacaauucguuuuucuuaauuuguuuguuuguuuccuuauugcacugguugagaccucuaauuagugacaaauaguagagauauuggacaucuuugucuuguucugacuugagugggaauauuuaguauuuucccaguagguuuaauuuuuaagguuuuugaugcuuuuuaaaaaaaucuaaggaaauuuuuuauugccuuauauugcuuauauauugaggguuuaaaaauaauaauguauuuaagucaucaaauguguuuuuucuuuuauuuuguuaacgugguagauuauauuaauauagcuccuauuauuuauugaaccaucaucuuuccauuccuggaaugagaucuguuugguuacaaugaaaaucugauagaauuuuuugcaacuuuucuccuuuuaauuuguauuuaaauauguauucauagcugugauuggccuuaagucuuuuuucuucugauuuggauuucaggguugugccacugauaaauaauuucagucucuuucaguguucugauguagacuaaauucuaaaguaauuuuuugcugcuuguacauuugauaaaauuuaccuguuaaaucaucuaauucugguggcauuuauuuggggguagacaugugcacauuuuuaauuuaucuuacaguguuuuuauuaacuaaggaaaucuuaugguggcaugggucaucuguuucguuuuacuguuguagccuuagcaccaugcuagucauauaaaagaugcccagaaaauucguugaaugaauccuuauaagguugaauagugcuuuuacuuugcuaaaguuuuauuugaacuguguuaauauuuuucuucuucuuuuuguuuuuucuccuuaaaguuccacucuuguccuggggacccagcuuuaacuuuagcaucugguauguugaacuuaguggcauugaugauccugauauaguacaaccuugucucaacugguauagcaagguaggacuguguuuuaaauccugacuuuaaugccuauaaaaggagaaauaugucaaucucuuaucuucauugagaauaauuuaaaauauucaaaauaauaauaacaacaguuagcuaacauuuuauuaagcacuuccagucugccagcuuuuaaggaauccugauaacucacuuagucauuaucacucuaugagacaggugcacuuauuauccccauuaguuuauagaugaagaaaugaagaacagagagauuaaauaguuugccuaggaucacacaauuguaaaguguuugagccaguauaugaauucaggcaguuuggcuccacagucugcuuuuauguuauuauacccauuugacucugaauuuuguuuuuucacuuguauucauauaaauacuuaaaacauaguuuuuagugggauaguuuugcagccuaauggaaaauuuaagauguggaugugauuuagacuccuaaaguagucaacaggguuaaaaaauacugcuguuuaauauaacuguaauauauauuguuacaugguaguuaugauaagucuuuuuuagaggccaagaguaaguuaauuauaguuaacuaauuauaauuaaguuguuaauuaauuauaguuaauuauaacguguaaggauuagguguuuaaugaccuuuuauuaguuaagucagcuaucaacugauuuguuucaaaucuuauacaucuuccuaaacacauuauuuucuugccuuauuaaagggucaugccuauaaguaaaucauuguuguuugauuaucaugcaggcuuccaugucaucuguuuguuugaauagugguauacuuaggaaguuugagguagucccagaacauauuccugaaguugagauuuuuuuaaaaaaauccuuuuuauaagauuguauuuuuggcaucuauccuauuaggggaaaauuuuaauaaauuaagugccugcuuuuuggauuccaguuaauugagaugucuacuuuauagcugcuuaauagaugagguaguucaggcuuagaaaacaauuaaauugggccgggcgcaguggcucacaccuguaaucccagcacuuugggagaccaaagugggcagauugccugaggucaggaguucaagaccauccugaccaacauggugaaaccccgacucuacuaaaaauacaaaaauuagcugggcgugguagcgcgugccuguaagcucagcuacuuaggaggcugaggcagaauugcuugaaccugggaggcggagguugcagugagcugagauuaugccgcuacaguccagccugggagacagagcaagacccugucucaaaaaaagaaagaaaaaaaaaaagauuaaaugucucuuuuugaugauuuuugagucauaaaauguguuuguaaauuugaaauaucuguauacuugauacuugucauucaaguaauaguuuauuuuuaaaaaccaaaaauagcauaauauaauuuauguggauuauuuaauguucuuuugugcucucaguaccugcauuguaaugggauuaauagaugcuauggaguuauaauuuuuacaguauuaaguggaguuuaagaaauagauguucucccuuucuucaaaguugaggcucuggaauuagguuugguuuaauaacuuuuggcuacauauuuugugaccuugagcaaguuauuggaacaggccaagcuuuaguuuugcuaguuaaaagagccaaauaaugauaccuaaugaaucagguuaguaaacugcuuggcacauaguguuaauaaaugcucaguguagauuaguuauuuuuacuguuguuauuguuuccuacaguaucaucuaaccaaaucucuucuuuccauacuuacucuguguucuaguaguaccgugaacaggaagcuauucgccuuugccuaaaacacuucagacaacacaacuauacagaagcuuuugagucacugcaaaagaaaaccaagauugcacuggaacaucccauguuaacagauauucaugacaagcugguguugaagggugauuuugaugcuugcgaagaguugauugaaaaggcuguaaaugguaugaaacuuagauugguuauuaggguaaauucaaguacauacgggaaacuuuuucucaaaaauaauauaggcuuaugccaguuauuacuguaauuuuuuuucuugguuuuuuacucgguuaaagauuguuaucucuuuggauuagggacuucuuucauguaaaauagauccaugauguaaugagacuuaaaaaauugaaauguacuugaacucacauauaaauuuaaguugucaucuugggaaaccaugcacuuacaaaugauuaacuagcauuaaacuguaucagaaauaauauuuugauauugguagccaauauucauuaacaguguaguuuugaggagaaggggggcuagauaauaaaaaauguuauuaguaaacaauuauauauaaggaacaaggagauuuguauugaaaacaacuuccuuguggugugaaugcuauauaauugcugauuuucuugugugaccuguagucuggcuuugaaagaaaugugaauaguugaacaucuguauuaucucccaggguauuggcuuuggaggguaacacucauuuggauuuuuaaggucugauguguuuuguuauuuaaacuaaaaagggacucuguuguugcuuauaguaugacuuuuuuuuuuaaucuuccucaguaacuuucauagugacaaacaacagaauaguugcacaauauaaaacuuguggaauugaauuuggugcauccuuuauaggaagaaauaagaaauaauagauuauucagugguuugcucucauuuuaauuuuaucacuguuauuaucgucuauuauuagguauucauauuuaucagauauuggguagcuaaaaaaaaaccagacuuguacugccuugaguuuauaaauuuaaaguuaacuuaaaaugaauugcuuugagcuccacuuuuugaaauaugacaaaucugcuucuaagccuugugcauuguuauugcuuacuugauugaugaugauacuugcaaauaaaugauagguauguuugaaauugaguauauuuuggaguauaaacaaacaaauaacuaaucucuuaacagacuuuaaaaugcuaccaauaaaaaaaaaauauauauauauauauauauaugccauuucuaggagugaauucuguggguuuuuuuuaaccucauaagaugagggaggcauagguaauuuuagggcuuuuuuguuuguuucagauauuuaucaguaaggcauuugauaccauuuugugaagggaaagcaaaacaacagccacaggcaacucuacaguuaauaagcuaaaaacaguuauauuuuaaaggucucuuuagugacguacucaguugguuaagauuagcugauaaaaaucuugugcaguuuugauaucuacagagacuuaacuuauccuuuggcucuagaaaggaaccaaguuuagagaaauuaguaguugcucaauucuugaaacuuacagccacaucauaguuuuuguacugugaauacuaugggcuuucuaaacuggccuggaacacuguuaguuaauaaacauuccuuucaggguuguucucuuugcuucugaucucauugaugaugauuuguuggacaaauaaggaaguaaacagugcagaguuuuuuggcuucugcucuauuaaaaacauagcagagaaggacaagaaguuccugccugcuaaauaggaagaucuagggaaucaaaagagucucugucaagcuucuuguaauggaggauacaaaagcuacuuuuaguauuuuuaguauauuacuuaguaugaucuuuaaguauuuucuguauuuuaagaaaguguaaggcucuauuuauuucuguaauaggcuuuuuguuugucuagaaacaucacuguauuuacauuucauuuuauuagaggugauuuuggaaccaauaauugcuacuaccucuuugcccaugcaggauccagugaugauaggcaaaaguaaucaccuagggacaggaauguuuuacucagacauguagagauuguacugaaauccacccuuugcugagcuuaucuuauuugcuauagaaagaaaaauuuucuuuugugagauaagggaaggauaaaguuuaauaagguagucauaaaguuucaaccugaaaucucuaccuuucucccuuugucuuucccugcuucuuucuuuuuucuguuuuccugguuuaaaaaauaaucucuccacucugguuuuuuggauugugcaguaguuguuaauuauaggcauaucuuggagauauugcagguuugguuccagaccacugcagugaagugaaugacacaauaaagcaagucacaaauuuuauuuccuuugcaugugcauauaaaaguuaucuuuccacuuuacuguagccucuuaagguacaguggcauuauuucuuuaaaaaaaaugcauauaccuuaacuuaaaaaaugcuuuauugcuuaaaaaaugcuaaugaucaucugagccuucagugaguuauacucuuuuugcuagugaagggucuugccucaguauugauggcugcuggcugauaaggauggugauugcugaaaguugggguggcugugacaguuucuuaaaauaagacaaaaaugaaauuugcugcaucaaugaguucuuccuuucacaaaagauuuaucuguggugugcaaugcugucugauugcauuugacccacaauagaacuucuuucaaaauuggagucaauccucucaaacccugcugcugcuuuaucagcuaaguuuauguaauauucuaaauccuuuguugucauuucaacaauguucacagcaucuucaucaggagcaguuuccaucucaagaaaccacuuuauuugcucauucauaagaagcaauuucucauccauucaaguuuuaucaugagaguguagcaguucagucacaucuucaggcucuacuucuaauucuaguucucuugcuauuucuaccacaucugcaguuaauuucuucuucugaagccuuuaacacuuuccacaucauccaugagcauuggaaucaacuucuuccaaacucuuguuuauguugauauuuugaucucuucccaugaaucaugaauguucuuaauggcaucuagaauggugaauccuuuccagaagguuuucaauuuacuuugcccagauccaucagaggaaucacugucuguggcaacuauagccuuacaagauguguuucuuaaauaauaagauuuucuugaaagucuaaaugacuccuugauucauaggcuacaaaauggauauguguuaguaggcaugaaaacauuaauauuccuguguuucuccaucaagcucuugggugacaggugcauugucagugagcaguaauauuuugaaagaaaucuuuuuuucuuuuucugagcaguaggucucaacagugggcauaaaauauucaguaaaccauucuguacacagaugugcugucaucuaggcuuuguuacuccauuuguagagcacaggcaguagauucagcuuaauucuuaagggcccuaggauuuuucagaauaguaaaugagcauugacuuccgcuuaaagucacuagcugcauuaaacccuugcaagacagucacacuauccuuuaaagcuuugaagccaggcauugacuucacucuagcuaugaaaguccuagauggcaccuucuuccaauagaagucuauuggaauguuuugucuacauugaaaaucuguuuaguauaguuaccuucaucagugaucuuagcaagaucuucuagauauuaauaacuugcugcaucuucuauaauacaucaacacuuguggcuuuacuuugcacuuuuauguuacagagguggcuucuuucuuuaaacuucaugaaccaaccucugcuagcuuccaacuuuucuuuugcaguuuucugacuucucucagcuuucacacacuugaagagaguuaaggccaugcuuuagauuagguuuuggcuuaagggaguguuaugacugguuuaaucuauccagaccgcucuaacuuucuccauauuaacaauaagucuguuuugcuuucuuaucagucauggguucacuuguaauuuccuucaagaacuuuuccuucucauuuacaacuuggucaacuuuagugcaagaggucaacuuucagccuaucuuggccuuugacaugccuuccucccuaaguuuaauuauuucuaguuuuuuuauuuaaagugagagguuuguguugaacacuuaaaggccgugguaaagauauuaaauggccuaauuucaguauuguugcaucucagggaauagggaggcccaaagagagggagagaaaugggggaacugcugguuuauggagaagucagaacacacacaacauggugccucaaaacaauuacauuauuaacaucaaagaucacugaucauaggucacuguaacagauaugacaguaaugaaaaagguugaaacauuacgagaauuacugaaaugagagagagacacaagugaagaaauucuguuggaaaaacggcauccauagacuuccuucaauuuguaaaaaacacaguaucugugaagcguggucaagcaaagcauuauaaaggcauauguauguugaauuaucuuaauugauuuucuguuuuuaaugcaauuuuguauuccuuuuuacaaacccuacuugauaauggugucuuacucuuuucagguauuguauuugaucugccaccuuuuuaugaaguauuuuugcauauauuuguguauguaagauauuggucugcaguuuucuuuuaaugugcaugucuuguuuuguuaucuuuugguauguuuggguacuuccagucuuauagaauggggcaggaaucuaaaaguguuuguguagaaugaguaguagcuugguagaauuuacuagugaaggcaacuggaccugaaguuaccuuuguguggagguuuuuguguucuuuuggcagggucucucuuugucacccagacuggaguacaguggcaugaucaguuaacuuuagccuugaacuccugggcucaggcuauccuccugccuccugaguagccuggacuauuggugcaugguaucaugccuggcuaauuuuuaaaaauguggagauggggucucgccauguuacccagacuggucuuuaacuccuugcucaaaugaucccaaagcacuggaauuucgggugugagcuauuuguuuguuuucucuuuuucuuuucuuuucuuuuuuuuugagacagggucucucucuguugcccaggcuggagugcaguggcacagucacggcucacuacagccuugaccucccugggcucaagugauccucuuaccaagccucccagguagcagggacuacaggugugcgccacuacacccgguuaauuuuuuguagagaugggguuuugcuguauugcccaggcuggucucaaacuccugggcucaagugauccaccugccuuggccucccaaagugcuagaauuacaguugugagccgccacccucagccgaauuacuucuuuauuuuauacuugguuaaaacaaacaaacaaacaaacaaacacuuuccagugucugaagcugucugugcuugaaauuuggugggugggaguguuuuuuaccuaucaguuuaauuucuuuaaacaucauaggacuaaucagaguuguuaauuguuugguucagguuuauuaaaugauauuuuucuaggaauugucuauaauugucuauaaucaaaaauuucaaauuuauggguauuaagguauaccuaauaucuuacuguuuguuuaguguuugcaggauuucuugagaugccccuuuuuuguuacuuaucuugaauauauauauauuuuuccaucagcacauguuuaucaagugcacuagucucuugagagaaccaauuuuugguuuguucaucuuuucugcaggauuucuugagaugccccuuuuuuguuacuuaucuugaauauauauauauuuuuccaucagcacauguuuaucaagugcacuagucucuugagagaaccaauuuuugguuuguucaucuuuucuguuauuuccuguguccuugacuuaugcucuguuuacuguugucuuccuucucuuuuugagauuaauuugcugucuuuuuauaacaacuuuuuaagccagaugcuuagcucauuaguuuucagacuuugaaaauuucccuuauauacauuuaaauauauaaaauuuccuccucuuguucuuuaguugugcuaugaaguauuuuuauuuuuguucaguuuaguauuuucauuaugaaaugaaauggcucuuuggaagaacugugguuuuuaauuuacaaauuuguggcgauuuacuacuuguuuucuuuguuagugauuucuggcauaauugcauaggggccagagugcauauccuguauguuuccaguccuuugaaauuuaaugagacuugcuauauaacccagcuuauucaauuuuuauaaacauaucauauauauuugaacagaaugugaauucuuuaguuguuggagcaguguuguauauuuguucaguuggucagaguugcuaaucauauugcacaaaucuuuaucaauaagaauuuucugucugauucucauuacugagaaagauguuaacacuuuccacuaugaucaucgaauuauauguuuccuauaguugguccaauuuuacuuuauacauuuugaugccauguuuuuaauugaaaacaaauuuuaaauuauuuugaauuaaaucuuuuauuaugaagugccuuuuuaucucuagaaauauuuuugcuuuaagguaaauuguauuaagaucuguuuucauuucuuauuuguauggcauaucuuuuccaucuuuuauuuucaaccuuuaucccucuuaagagaaauaucuccuauaaauuuuauuuaaauaaagaaaauuuuauuuuauuaauaaaucauuugacuuaugauuaguuuagaaauugcaaguaugcaugauuaccuuaacaaaauugaucagugccuuuucucucuucccaugugaggauuuaguagacuuucagcuucauauucucaccuucuaauucauuauucuauuguugucaauugcucuauuguugucauuuauuuugauaccauguucaaagacccuauaaaauauuugucuuauacagcaauuguucauuaauuuuacccaaauauuuacuggguuuuuuuucucuucauuauuguuugcgucuuuaaucuuaugucuaggauuguguucauucccugugccguaagcccauccuuuagaauuucuucuauaaugcagcucaacucucucagaauugauggccugaaaauuuugucuccuuuauaggaggguauuuuugcuagauguagaauuccagauugacacuuacuuucuugaaauacauuuugaauaucauucgacuguuauuaaccagcuuccuuguugcuguugagaggugugcuaucauuuucaacugccauuuuuuaauauaaucuuuuucccucugacuguuuaaauauuuuauauuuguuuuagauuauuuuguaguuacauuaacaaggcuguccgaaacuccaguguggcagcccuguuaacuauugucuauuuugguuuucuuucaauuaaauauauguugccuuugucuaucauuuauuuucuccuuuaucuuuuuuaacugcacauuucuguuuaauauuuuaagcuucucuaaacccuuuaucccauuuccacuacuauauuauuuuuagugucucuuucuuacacuuugaccuucaguucugugauauuuucaauuuuuucauuccucuuuucucucauuucuaacaauuccauuuuuguuuccuuugguugucuugccauuucuuuuccaacuauuuagaugucuacuuuccaacugcuuauaucucuaaucuguacucauguuucauagagagaguugcuuuuuuuuauuuguggaauaaauuuguggaaagguauuuggcuacuuucaucuauugcaggcuacauuuuucuguugaaucagauucauuugcuacuuuaaaaaauucauuucuuuuccuuuuuauauuguggcauaauuccuggguugauucuuuuuuaacauuauuaauauuuuaauguggugaauuuuuccuauuuuuagaagcuucuugugaguuaggagguagggcuguguuccaggauagcaagauuuuuccuuauaacaccuuuuuucucuuuaagauuuuguuucuuagcaaugcucauaaugcaaaaaucucacuuuuuuccccuuucccaacugccagacccuuuuccugaaacaugguuuuuuuuuuuuucauaauuuuugcucauuuaugccuuugugccuuuguguaugcuguauucucuuuccuauuacuuuccuuuuuauauaauucaguuccagugcauucuucaaagccaacucuuucaagguaucuucuuucauuauauucucacugaaucacuccuuccuccucuuaacuccuauuugccuuggugcuguauuucucauuuuguucauaaaagauuguuaauuuucugucaaguacauuuccaaacacugcaucauugucaucaucaucaucaucaucguaaguaacauacaucugagagcuugacaaugugccguuuauucuccuaggccuuuuacgugaauuuauuuaauuuucauacuuaccuucuagguuaaguauuguuguuauuuccgucuaauauaugagaaugauuaauuugcuuaagaugguguaucuaguaagugacagagcuaagauuugaauucagguagucuggugccaaaaauccauacucucuaucucuaagcuuuaccgucuuaguaaauauuuacuaguucagugucauaauauugacuauuauauucuuacugguauaauauugcccuuuuuuucagaauuuggacaaacugaugaaaucagcuucuuaaaaauucuuuuugaucuaaucauucuugaauggucaaaaaggauuuuaugcucuauaaguuauuuaccuauacaugcauuuuaaauuauuucuuuuguauguaaucucuauuuuggugcaaaaucaaauuugauaaaaguuugaguuuaccaaauauaaauacauacaacuaggcagcaguacuauaaucuauguggauuuuuuugguuuuguuuucuuuuuaauucugggcaagagauuugaaauuuuuuccccuuuuggugaaagcuuccuaaaucauguuuuuuaaaucauguuguauguguaugugggcaugugugugcaggcaggauuucuguguugcccagacugguuuugaacuccuggccuugaaugauccuccugccuuagccucccaaaacccuaggauuacaggugugagccaccaggcugggccaucaugugcuuuuuuaagagaguauccacuauuauuggagaaaagaacagcuugugcucagugaggacuguaugaaauauauuuauuauagucauaauuauaggagaaaaaaugaagugauauuggaccuggagacucuaguuaaauaguuuaaaaauuauuaacaacuaguucuuagugugcuuucuccuagugauauuuuaauuucuuuuggauaguuuuaauuuuaucugacuguucugaucucuugcuuuagauuuuugucaaaaauagacuuacagaaauauuagcaacugccugacuucuucuuuaaacagaaauaauuuuugaacucacaugguucacaggcaucuuuaaauuucuuauuuacuaauuuguuucuaagauuuucaaacaguguaauggaugucauauuuuuauagaugagaauaucauuguuucaauagagaggcugacuuuugcugaauuauauaucuaaagcaagccuaccaaggcaaaaggccuuauuagcaagcguuugcaagaauuagaaauaauagggagcauggagauuauuugggaugcagaggugucaacucuuuguuuuuagguugcgaaaguugcaggaaguucuuuuacauuaaaacaagguaguaaaagcaaugcauuuuuuuaaccuuuacccugcuuuaguauuugcaguauuuacugacuuuuugcaagaauuuugaaaagucucaaaggcaaagaagaaaggaaauuuggugagcgugccuguaggauggagguuuccaguuaaagccagcugaaaagucuugaaagcgaaaggguugguuacaacugagcuucauaauuacccagaaaagaaagauuagggggagugcucuaaauugguuggucucuggugaauauauaaaucgcagaaaacaguuuuacuuuuaaauugagucacaugacagaguuuaauaguaaaaguaacuuuauaaauuaugaucuauuugggugcauguaaaagcuaggguuucuagcuuaaaaaguaaggaaauguuauuguagcacauagcaagaaguccagagguaaggcagauuucaugguugguugauucagugaucauuucuuucuuucucugugcuguaucaucauuauagaauugacugcauucuuguacuucgacaaauuugcuuuaauauuuguauacauuacaugcagauauuccagaggaauaaaaguagauuuuuuuuucuguaugucucuuuagaaguaaggaaaaauugccuagaagucucccagaagauuccucauguuucauuagccaaaauuggguuccauacuguucuuaaacuaaucuuuguugagggccaugggaguagggcuucauaauuauuuagguguguauguggggggauguauguagggaguucagucuccauaccauuacaguaacuaguguaacaacuuaaguagauuaugaguuuaucaauacagcagaaucaggaguaaggaaaacaugguagaacuuuaguaccagccccaccauuuaagagcugugugauuuugguuaaguuucuuacuuuuuuuaaauacaaauuucuggauuuauaaaacggagaugauaauguguaguucauaggauuguuuuuagaauuaaaugagaugagacagcauaaauucuaacauuugguaaguguuccauaaguauaguuuuauuacugcuguuaguacuuuuaucuuuauguaguuuuguacucaaaacuguauaauaauggaauucacauguuaaaguuaguguucccuuuuccugaaaauguaucaaggaccuagaccaaaauuauuggagcucuauuuucuucucuaguucucuuggauauggguggcaaaaaguacuggcacaaagcacuguugggggaaagagauuaggauccaaugaauccaugucauuauaggauguaaagauuaagaauuucauaguugaaauaaagacaaguggugggagaucacaaaaagaaaauauaauucuccuaaucuuuaguuauccuuuccucuucuuaauuauauuuaugauaaugauagaaaugauuuuuuaaagauauauaagaucuuuuuucaaugaaguagaacauuuauucagauuauuuauuuuuauuuucuccugcuucuauuuugcagccuuaaauugucuuaugacuuuuuuuccccucccaguucacucccuuuuccuucuuucaaggucucuaacccucugauaaugucacauacguguccguugaaugcaacagugacuuuguaucuaauacauacagugaugaugagaaacauaguacguuuaauaugagcuuccccuaaagcaauuuguuugcaugguugugucaauuaauauuuuacuauuuauauuugagguagcaugaagugaaauugaagugaugcauauuuuaugaaaaugugcuuuuguauuagugacauauuaguaauuucuuuuaauguagccuuuuaaauuuuaauuuuuuucuauaauaaauaauguaaguaguuaagguguaauucuuucucauucuucaauauuugcagauggcuuguucaaucaguauaucagucaacaggaauauaagccacgauggagucaaaucauucccaaaaguaccaaagguaagccauaccuucuagauuguaguucuuuuucauuaaugucucagucuucaguuuucccaagguaguucaaguaucauaguacuaaguuaauaaaaaagaagauguuggccaguugcaguggcucaugucuaaucccaauacuuuuggaggccgaggcaggaggauugcuugagcccagagguucaagaucagccugggcaacauggugagaccugucucuacaaaaaauuagcuauacagccgagugugguggcucacaccuauaaucccaacacugugggaggccaaggugggcagaucaccugagguuaguaguugaagaccagccugcccaacauggcaaaacccugucucuacuaaaaauacaaaaauuagcugggcgugauggugugugccuguaaucccagcuacucgggaggcugggguaggagaaucacuugaaccugugaggcagagguugcagugagcugagaucaugcuauuguacuccggccugggagacagauggagauuccaucucaaaaaaaaaaaaaaaaaaaaaaaaaaaaaaauuagccagacauguuggcaggcaucuguggucccagcugcuuaggguacugagguagaaggguggcuugagccugggaggucaaggcugcagucagccguguucauaccacugcacuucaaccugggcaacagagcgagacucugucucaaaaaacaaaacaauaaccacagcaaaauaaauaaaaagcagauguuuaaaacaaggcauagguuccuuaacuagguggcacaauucauuuguuauauuaaaauuuucuuuuuaaaccuuuuugauuuacugccguaacagaagguugggcagcuuuuacacagaauaucauuauaaacugcuuuguuagaggcaugguguaaaauuauaggcuguguuguaaugccauacacauguucuugaaaaccuuaaguuaugcaaaauuauuugcuaaaccuagcaaggcauauaagaaaaauagaaaggcagaagaccauucuaaaucuguggaacuuuauaaccagcuacuaauaaaaacuaguguaauaauuguaauaaaaauaaauaucaguacauuuaaauuagguauuuauauugaacaucauaguguguuuagagacuuaagcccugggcucaugccucugucuuugaaauguagauccuagagggcauuugcuucuaauaaagacuguuuucaucaaaacuugaaaucggauccagaguauagucuucuucaugaauaccuuauuuucauauaaggggggagguuuugucacuucuucaucuguacucacugcuuugccagauaauuaacauaguggaaaguguagcaauuucuuaaugcaacuguuuguguuaaaggaaggcaguucuauggauacugagcuuuuuucauuguggucuucauauauuacuaaggacuucucuuuaguugugagaaagcuuucuccugauaguauugcauauuaauaugcaggggaaaauugcuuaagaaccuccauaauugauguuacaugaacaucauucuccuauuuuaucagucauguaugagguaauuuucuucaaagacacacauauuauagcaaacagacaguaauuguguauuugcaaacuaauggauucaacauauaaaauacaaacauacugaaaaugaauucauuuuagugcuuucuuuuuucccucagaccucucaggggugaauaugcuuucuaaaucuauucuuaaagauggcgauacgguacugacugaugagggaaggaaagaagaaaagggcaaagcuucaaugauaauaaauugcacaaucuaaaggcuuaacuauuaggauaaaggauuuggagggaacuucuggaugauuagccgcugaauacaguaguaaugaaaagcuucaguuuuguaucuuauuuucuguauauaagaacugacauuucagucauuuucauagcacccuuguaaaauuaguauaaaauuggauauucucaauuuuacauuaggagaaagccaauacagggaaacuuauuagccaaaguaauauauuucaacuaauaggagaauuaugaagaaagccuuaggcuuucuaguucauaucaaguaagacauuagaaucuuacaaccuuuugaacuacugaaauuaauuuauaacuuuuuuuuuuuugagauggagucuuacucucguugcccagccggagugcaguggugcaaacucgguucauugcaaccuccgccuccugaguucaagugauucuccugccucagccuccugaguagcugggauuacaggcacccaccaccaugcccggcuaauuuuuguauuuuaguagagacaggguuucaccauauuggcuaggcuggucguggacuccugaccucaggugauccacccaccuuggccucccagagugcugggauuacagguuugagccaccgcgcccggccauaacuuuauuuauguaagauuugguguaaaguaagauuagauacaaguugaauaauaguguucucuuuuggaaguuuaaauaaaguuuuacugauuguauuuaaaccugccuauuaagcucugugauggaaauaagaaucaaagugaaguaaaucuuagauuuccucagucaguucuuacauaaaauaguugguaaauuaggugggaacugauugcugaaauauuggcacaaaauuaauacauuauacauuauacaaaguuauauaaaauaauuacacaaaguacaaaauuauacaaaaauuuuacaaaauaauuguauacauuauacaaaauuaauaucauuaauauaaaacuugauagcaucuuuguuuucaguaaauaguuugauaacucgacuuuaaaacugcucaucauacuaaugaacuaugccuagaauauauacgggagaucuaauuuuguaauuguuuuugaccuucacuuuggcacucaaguagcuuagagauuuuuguuuuauguuuuuguauaauauucugugucuuugcugguuuguggcauugaucauaaauaaaucaaaaauaacuuccaaguucauuaauguccugaaagcauuuggaaaaaagaacaagauuauuauaaacacagauuugagucauacuguuacuuuuaugaguccuuuuacuuauuaauauuuugaaaaaauaaggguggguuauuuuuacuacugauuacagacuuaugaauaaauuuacucuggauaugcuguucuuuguuauuccuuuaaaagaaacuauuauuucuucuaaaggugauggggaagauaaccguccaggaaugagaggaggccaucagaugguuauugauguucaaacaggugaguagcaguugcaguggaaagcaaaaucuucauuggcuacaggcaucgucuaaaccaggcaguggcagguaaggaaggggcgggggguggggggcucuuacacaaaugaaauuagauuaccuaaaaaaaguuuaacaugcggccuuuuaugugugucuguauguguguguaugugucuaguuuauauguguuguauuuucauggaaaacugguguauuucuggauuuuuguugcacuuauauaguagaguaauaugggaauuacuggaauaaagagaacuaagauauauuuuuagaggaagcagauaucaaauuaggcagcuaaguguugguaaguccauuaauugcuaaaaacuguucacaagccuguaaauaauuuaguuguuguuuuuuguuugguuuuguuuuuuuuuuuccugucuuuuaaauuuuguucugaagcuugguagcaaacuuuuuuuuaaguuucuaaaaccuaggaaaacuuaauuaccauaauauuuagagguuaaugccaacauuauaauaggucucagauuagcagcuuaaaaagcaaauaauaccaauaaucuaccauagcuauauuuuauuauuggauuuuagaaaacuuuacugcauagaauaccacucuuuccaggcguaaugaaugcucaauuauacuguguguuaugccaacucauagugcuucgggaauaaaauaauugcuuggagacucauauucuaaaauaauuaagaauaaaaaugguuacaauguagacacuaagucuucuugacaugaauuuauuuucauaauuuuuguaagaagagaaauuauaauuuuuaauuuaaaauuaaaagcuaaauuucuaugauaaccucugaacugguuugagacuguuauuagggucucuuuggaaaagguucauuuuuaagguauaggaauucacuuucuuaauuuuggucccucuuuccaaaugccuuucugcccugcagaaauaggcuugaauuagcuauagagucuuaggcaucuuuuuuucugccugagaguauaauaaauauucauaugcuuauuuacuaaagagcuagauuuauauacaaacugguuuuuuauccagaauaauuauuuaugaauauagacaugaaaauuuguuuuuagauugucuacacaguagcuuccccuuuuuuugaacauagaguagaauuuguaaugcuuuucuuuuuucuccaucaguacuauaaggaaaauauuauuaaacaccccuccccugcccaaccuuuuuuuaaaauagagaugagguuuugccauguugcccaggcuggucuugaacuccugggcucaagcaguccgccugcugcaaccucgcaaagugcuuguauuacaggugugagcuaccauguccggcccacccuuucaaacaaauuugguuguaguuugcuauaauaauauacuaaaucuauguuuauuugaaaggagccuuuaccuuuuaaagcaaaaugcacuuuccuuaaauauaaaaguaauaugguuuacuuuaacauuuaaaguucaccuuaucuggggaggcagaaggaauuuucauagugcuuacuguguuaauuauuaugagagaugaaccauaugugauagguaaaguacauguguaagaaagacaaaaaaauuuuccucuuuuuauaauccaugaaauucgaaaacagaaaauuauucaaagaauaggcaaaugucaugacagaacuuagugugagcaagucauugagaauuaaaaucuaacuuuucaggucagagagccuugaaauacuuacaauaaaguuauaaaggccuagguauuuuucuuucuuuuuuuuuuuuugagauggagucuugcucugucgcccaggcuggagugcaguggcgcaaaggccuagauauuuuucuauaauauuuuuguuuuaugcauuagggguaggauuucagcaaagucuugauggucaggguccuuaccccuacucccuuuaaaaaaauauuucagcuaggcacagugacugucucgugacuguaguugcaacacuuugggaagccaaagggggaggaucccuugaucccacaaguucaagaccagccuaggcagcauagugagacccccaucucuauaagaaauaaaaaaaucagcuggauguggugguguaugccuguagucucagcuacucgagaggcugagucagaaggauugcuugagcccaggauuggaggcuacagugagccaucaucacaccacugcacaccugccugggcaacaaagcgcaacccugucaaaaaaaaaaaaaaaaaaaaaaaacucaaagaggaaaaauguuauuugaguaacuacuagauuuacuuuagaaauuauaagaaagcguagcgagaaugacuauuguagucauggaauuuuacuccagaugggaccuuuaaaagaguaaucucuuuuugauagcuucuaaggauuuauuauagguuagugaagguguacaaagaaaaaucggccuauauccacacuucaauauugacacuaguuuauagaaagcuacagaaguacuuuagaaauacacuuuuaagcaaauauuucuaccaaagaaaaucuggggaauuauccuguuaguagauauuuuaguuagagccauuuuguaccuauuuggagugcuuucuuuuuuucuuuuauucguuaugaauucugggucaaacuuuauuuaggcccaugguugaugacaaaacuagauuuuucagccuuuaaaagaaaucauggguggucauuuaauauacaguugucuguugcucaaguucucaugcuuuucaguauguuaccauugccacauauaguguggaaacaguacuaacuauacguggacauugaggucgaaaggauuucaccagauucaggugguccuugauaucaguaauagagauggcauauaaaacauuuggagguggaauuccucuucuguuuuuuuguuuuuauuuuuuacguucaaaaaauauguuuccaagaagagcuaucugaaaccuuuugucgacauuuugauaucuuaguacagaaauagggauagaagugaugauucguuuuaaauuuaucauucacuauagaggggaagacuagaaggacacauaccaaaauauugacguuaguuacgucuggugguacaauuaccagugauuuaaaauuuuuuuauuuaaaauguauuuuuaaaauuucuacuuaauuauaaguuggagaaaauuuuacucaacagcauucuuuuuaggaaaagaacuguauuuauuugugaaggugcuuuggaguacaaaguaaaauacugagaccugauuguagaaggaacuauuuuuguaacacuaagagaaauugucucguuagcaccagagaaauggaacaagaaauagagauggccgggcacgguggcucacgccuguaaucccagcauuuugggagaccgagguggguggaucaccugaggucaggaguucuagaccagccuggccaacaugguaaaaccccaucucuacuaaaaauacaaaaauuagccgggcaugguggcaggugccuguaaucccagcuacucggggggccgaggcaggagaaucacuugaaccugggaggcggagguugcagugaggcgagauugcgccaucgcacuccagccugggagacaagagcaagacuucgucucaaaaaaaaaaaaaaaaaaaaaaagagagauaaaucagggguguucaaucuuuuggcuucccugggccacauuggaagaagaauugucuuggaccacacauaaaauacacuaacaauagcuuaugagcuuacaaaaaaaaucacaaaaaaagucucuuaauguuuuaaguaaguuuacaaauuugucuugggccacauugaaagccauccugggccucaugcagcccaugggccacagguuggacaagcuugagauaagugguaguagagccagcaggauggcagaaugccacauuucaugacaugacucugucuuuacucaccaaauucuuagaaguuuucucuaguaaaauugauuugggaguugauuuuuauuuacuuauuuuuugguagauacuggugagacaauuagguuugggguucaaacugagguaggacaguagugaggcaacuucuguggauuccaaugucuggaagcagaaauaugaggaaacaugcccuggaacucaauaggaaaagcucugaacuuucacaagacugaaauuaugguucagguuaaauuaaacaggucucuaguugugacuggguaauccaggacucugaucaagagaaaacaaaagaaaucagaaaauacuauucagaagucuaacaacuuucaugccuuggcauucccaaucuuuuauuucagcuagcuauugcugucgauuuuuuguucuguucucaguccuuuggcuauuucauguuuguuuacaugaagcuucaugaauagauuuuaagggagcccaugauagucuuuaaacggugugcaaaauuuuuguuuuuguguaguuuucugggaagauucauuacauauauauauguauauauauauauauauauuuuuguuuuuuuuuuuuuuuugagacagagucucgcucuguugcccaggcuggagugcaguggcaugaucucggcucacugcaaccucugccuccgggguucaagugacucuccugccucagccucccgaguagcugggauuacaggcgcccgcccagcuaauuuuuguauuuuuaguaggacauuguugugccauguuggccaggcuggucuugaacuucugaccucaggugaucauccugccuuggccucccaaagugccaggauuacauacaugagccaucgugccuggccucauuacagauauucuuaaaggacuuaaucccuaucuuaauugacauuuuaugguaaguacugcugaaccagguauucaaauaaagugucuucauacaggugauauucauuauugaacugauauuauuacaaaguaaaacauugccaccuuucuacuacucuugguuuuuuuuccagaauuuuuguugcuagaucagagguaugugagaaagagagugggaagaggugaagucagagaaagagagugggaagaggugaaaucagagaaauagcugggggcacaaacuguguugaguuuuuuaggacuuuguuuaggacuuuaaccuacaugcagagugaagugggaagccauuguuggguuuaagaaaugcuaugaacugaccuugcauuuuaacaaaacaaauugagugaagggcagcgaguccuuuaaggauccuauugcucaccugagaagugauuauagcauuggcuuauacuagaaugguaguaguaauguugaaaauuggucacauuuuggauguauuuuaaaagguaucauauaaaugcuaaaugacgaguugaugggugcaguacaccaacauggcaaauguauacauguguaacaaaccugcguguugugcacauguacccuaaaacuuaaaguauaauuaaaaaaaaaaaagauaguauguggaaugagcccaucagcuggcugcuuaugaaagaguagcuauuagugaguaugagaaggugaaagagaaaaagagagagggggagcacaugguggcagggagagagagagaaacuagaaaaaaaaagguaucauauagagcugacaggauuuuuugaugaacuggaugagaagugugagaaaaagaagcuaaggaugacuuaaaguuuugaccugagcaauuagaaaaaugguguaaccauucucuaagauggguacaacaagaggauccaauaugguaauaugguggguuguucagcaacuugauuuuagacaaguuaagucugagaugccaauuagacaucuacauagguaugucaaguaagcaguuggauauauuaguuugagguucaggagauagaucuaaccaaaguaauaauucccucuacauuuauguaacacuguucaaaccauuauuacuacaauaauuuccacauuguuuuagaguuguucacacaaguauuguauauaccauugcugucucuccagcuucccagcccccauggacaaggggggaaggacagggaucuugccuuauuuauuuuuaugacuauagaggcuagaauggaguagaugugcacuaaauauuuguuggauuggaucaaaguuuuaaaauucauuuuccuuugaguagaaagaaaaauauuuaccuggaaacuguauucagauacugcuguaaaccuugauaaguagaucagguuauuaugucauuuauuauacuaauauuuucugugguggaucuguuuuauugguuauauucgaacauauuuaaauuuucagauucuacuuguuaugccauuuagacuaugcuucccaaagcuguaauuaucauuacuucgggaucuagguagaaaaacuaaauauagagcuuugcauuuguuaaaguaaaauuuguugcuuucugaacuugguuugggcucaagugcacaaucugguguauccuuggguuuuucucuccaaaauuucuucuguguuucuauuaugacuauuaguagcauaauuuacugagggcuuucauauacucuaaguaucuauuuaaucauuuagguaccauagcccuguuauugaucagcaguuaccuuaauuaucagguugaucuuaaucacuuucaaagagauuguauuuaucaucaaucuuugaaagaaccuuucuagucagaucuuaaugauauggcagccacauauaauagguagguguuaaguuugugggaaggagaguugggugucugacaucccugggauugaauccuggcucuaccccugacuucuuauucgaucuugaaugaauuguauugauuaaaauggugauaauaaacuaaguaauugugagaguuaaaugaaauaauguauuuuguaugugcauauauuauuuauauaacaugcauuugauaugccauauauuaauaugcagcagugauuaauuaugcugagagaauuuuauaugacucaaaggaauuuucuuuuguguguuuuuugcauaauuugacaaaauuucacuauggaaauguuuuaaaguaauuaaaaaguuugugaaaaaguuuaaaacaacuugaaaagcaguguugaggggaaaaaguaacucacucauaauuccacauucuaaaaaaccaauguuauuuugguauauuuguuuaaucuuuuauauaauuggugccuuaggaagggacaccauaaauauauuuauaauauuuuugagacaaaauacuaaagugcauauaagaauuuucuugaugaagaucagguagguuuaguagugaagaauaacuuucucuaaguagaguuugaacaaccaggaaauuccauguuaacaaaacuggugcauaaguaguaaaauauaguuuaaagaagcccaguuauuacuuuaaguaugcauuuuaaaguuuucuagcacaaggauucuuuaucuguugaaguuaggugcaacauguugucuguuugcaaauuuuuucuaggaagaaaaucuguggcuucagauaaucaaagagacucuuacuaacucacaaaauuaagaacacuggccagacaugguagcucauaccuauaaucccagaguuuugggaugcugagguggaaggaucacuugaggcugggaguucgagaucagccugggcaacacagcaagaccucugucucugcaaaauauuuuuuuuaguuagccaggcauggugacaugugccuguagucccagcucugugggaggcugaggcuugaggaggauggcuugagcccagaaguucgaggcugcagugagcuaugauugugccacugcacuccaguccagucgacagagcaagauucugucuccggaaauuguuuuaaaaaaagaacaccuucacuagaguaaaacuucauaaaguuaauuucagcuuauuuaacauggcuuauauuuuaaagcaauuguugcuucccggugucucauauaccuuguuuucuuagauauuagaaacuuaauaguaccuagcuuuuguuuucuuuuuuuagucuguaggguuuuuuuuuucccauauugcugucuucucuaaggauacagugaccauuuuaaaagguguaugauggcacaaauuuuauuauuuaauuuucaaagcuuucuucccuccuaagggaauccuaucauucaugccaugguagagaaggaauguuguauucuguccuacugaauuuguccuacuggaucaguuuuauuaauuguaaucccuauaccuggcaccucuccacuuaagauucuucaacugugacuuggguuucgacugggaaaagaacagugaauagaaagagaaaagccacgucuauuuuguuucaguguggaagucuguugaguuagaaauauauuaauaaauuuccauuguguuaggcuguuccuuguuguguaacucucauuacguucugagaaccuacgauuuaagccuuuuucuucuuucucaaucagaauagguaugaagacuuaggcaaagcucuaauauuugguaucuacaaaagaaguugauggagaguugcuugucacuuggaagagccuuucuguagaaauuugaaccuuuaacuguucuguagcuauuauaugaaagugcuuuuauuauuauuuuuauuuauuuauuuauuuuuugagauggaguuucacucuuguuguccaggcuggagugcaauggcacagucucagcucacugcaaccuccacguccuggguucaagugauucuccugccucagccuccugaguagcugggauuacaggcaugugccaccacgccuggcuaauuuuguauuuucaguagagccaggcuuucuccauguuggucaugcuggucucgaacucccgaccucaggugauccgccugccucggccucccaaagugcugggauuacuggagugagccaccacauccggccugaaagugcuuuuauuuuuuuacaugugguaccacauaguuuuucuugauguuccuuaaagaaacuuuugaagagagugccuaaacauggguuuugguugcuauuacaaauuuauucauauggcuguacuucugaaaguaaugugcaucuuucuuuuacacuguuaacagaaagaauucugaaaugcagacuucauuaggaauacaaaguauauugucauaggcauaacaauucagccuuuuaguaaggaaaguaacuguauguugaauucacccaaaagauuuagauaguguuguaaucauagcuuuauguaagaauacaguucuauuuaaaaagggaggcagugaauucaguugaugaucugcugggucaugauacuucaaggggauggcuuaagaagggaaagguaaagagcauauaaaauauuuuuccccucuucaaaaaauucaaaaauauuucugucuucaaaaauugucauguuaauuuaagucuuacugaacuucacuuuuagaagcauucagacucuaucuaaauauuauagaguuuuauuucuaucuuaaagauaaauuuguuucuuaaaaccuuuuuuuaaaaaauuuuuuucucucggugucuuaacuaagaauuaagguaacuucuuucaccagccuguuaacccuuccccugccucuucuuuuugauacaugaauuuugucuaaguuuugggcccaggcuaugucaaugcguaguauacacauccuauacagugucagaguggaaaaacugauuuaauuacaaaaguagugugccaucuuguggaggauuaugcaaucagcacagucugauuuauccuaaaaaucaaaguagaagacagauauugcacuugggcacuaaaaauaaaaagccuauuccauugugcaaaaagacacugagaugucuuuauauaccuuacauuucuacauuauuuuuagugcauauaagauguguagauugguacuacugguagucgguagcuccaggguuuguuuuauacugguaccaaauugguacauguacuauaccaaagaaugugguugaauuuuaguuuuuguggccuaaguaaugaaaaauagauugauuggugauugacucaguguuuuagaaugaaauuuguuugccguuucgaacauaggccacuuuaccuccaaucccugucauucucaacuccuucagucaguccuguaugcugcaaguucagauguuaccuugcuaccccucugccuaagaucuucuguggcuucuccacugucuguguggagucaaguucaaagucuuuauccuguuauuuaaucccuuccaugaucuggacacaccugucuuuuaaccuccucuccaccuccuaccuauguguucuuuuaaaucaaacaguguauuuauucaucacacaguuuaaccauuuaacaugcauuauuuaauuuaauuuaauucucacagcagcuuuaugggauagauacuguaucacaucuuagagauuaagaaaccaauaguuaaggaacugugugguggucacauagcuguggugauagagccaggauuguagccaagaucugccugacuagaguacauguucauuaaaacacuuuugacguguuuuucugucucuauacuuuugcuauucuuuuuacucuguuugaaaagcccucuuuuuuuuuuguucuguauccugccuuccugcuggugcauaggucaaauaccacuguuaccaugaaaucucuucugaguccccucagccagauauacugucuucccucuuuugaacccucauggugcuuuuuaccuuguuuaucuuucuuaugacauuuagucugcccugcguuauguugcucuauuugccuuuugauauucuuggcuagauuguaaguuccuugaggauagggacuggggacuaugucuucuuucuuuugaauucucuaaagugcuuugcgaauucucaguacucaaaaaguguugaauaaacauuccucaaagugcugggagaaauggauagacacuauagccuauaucccauucagaaaaaauauagagaaggggugaagggguugcuccuugaagaggaucguacuaccccagauguacaugaauuauuauagaaccuauaagcaugagaaugggcuuccauaaaccaaucuacuacccuacugcaaauauuaaugcuuucuuuuuucuuucuacuuccuucucucuacaguucucuccaauuauauccauaauuuuuaaaggucuuugauauccuuugugcauuaaauaauaccuuuucuggugucuguuucuggauaauaguucuucuuugcaugacuuaaauaauuagaugaauuaauuaaaauuuuuguuacgcauuuucauucagguaugucagaaggcucaguuuccauccgauucauuuaauuuuacuauuaaacuucagcugggaccacaaagcuuucauggauaggaaugacaucuuggcuuaauuccauuaggaugcuuacugcgugccagauuuuauuuugcucagcuaucaaugaggcuguuguggaaauguggguuuucuuugcugugagaauuuaugcguacaaagagaccugcuuuucagaaagaacauugagaacccagagcccaagaggaaggguuauuaaaguuaaugaaccaggguaaccuuauccagagggugcccagaaacacuauaaaacaaaaggucaauugcuauugcuauuuuaguuauauacccccucuccaggcuucagaauuuaacaggguuaauuuccuuuauagugaggacuuggcaaauaauuuuuaagccagaugaaaauucuuuaauuuuuuuuuucuguaaaauuaugugucugaguauuacugugugccauuuuggaaacagaauguuacuuaacgaugauaauggauuguuuuauaguuccaagauaggacaguguuuuuuuuguaguuuaaaauaauuggcauuauuucacacuuauacagugccaaaaguguuuuauguacugaauuagacauguagucaguuauaauaucauuuuuauuguacuuaguaacuacagaguguuuuucauuuuuauguauauuuuaaagguggaaaugauguucauacuugacagccuucagaauguuuucauguaacuuuuuuuuuuuuagauggagucucgcuguguugcccaggcuggagugcaguggugcgaucucagcucacugcagccuccaccuccugaguucaagugauucuccugccucagccucuugaguagcugggauuacagaugugugccaccaugccaggcuaauuuuuguauuuuugguagagacgggauuucaccauguugaccaggcuggucucaaacucccaaucucagaugagccaccaugccuggccucauauaacuuauaucugaaggacuugacaacacugagaguuuugcagaugaaaaaaacuaaaaccuagggagcuuaaaugaccuguacugaucacccaguuaguacuagaacucaguccugcuccaguggccuguucuuauccagaaagcagugaagcauuuuuuuauuucccgugguauuugggggauagaagagacaaaucacuugaaaaauuuacuuagaguuugaaauuauaugcagauaugacagaaaucuuguagaagauagccuaacucugugaauggcaaaagguuuucuuaaauagucuucuagcauuuccaaguacacuuugaauuguaacccugcauggugggauguaacuuagaugacagcuuccauauguacaggccuaaagcguguuaguuagagaguacaugacuuuacaguuuucguauaguguuuuauuuaacauuaaaagauaauaauuggugggcuuauacaacugguagacuuaaaacaguuacaaagggggaaauauuugaagaaaggaaacaacuuuuuuuuuauuuuucauuuuuugagacagagucucacacugucaccccaggcuggagugcagugaugugaucucagcucccugcaaccucugccucccagguucaagugauucuccugccucagccucccgaauaguugggauuacaggugcccgucaccacaccugccuaauuuuuuuguauuuuuaguagagacggaguuucacuauguuggccaggcuggucucaaacaccugaccuugugauccaccugccucagccccucaaagugcugggauuacaggcaugagccacugugccaaauuggaaacgccuauuauugcaugaagaaggggcugaaugggguggcucaugccuauaauccugguacuuugggaggcugaggugggaggauugcuugaggccaggaguucaauaccauccuggacaacauagugagccccugucuguaacccccacccccccaaaaaaaguuagcugggcaugguggcacauuauuguagucccagcuacucgagaggcugggguggagggauugcuugaacccaggaggcugcagugagccaugauugcaccacugcacuccagcaugggcaacagagagagaccgugucucaaaauaaauaaauaaauaaauaauaaaaauaaagaaggaucuaugauacacaauguuauauguaaagauucauuauucacugaagaagaaaaucaguuuugucagcgguaaagucugugaauauaauagacauuucagagucagaagaaaccaaauucucaagauacuuagaaugacuuaaaggauaauuucugaugaguuaaauguaccacaauauaucuggaaaaauuucucccaguuuuuauaggaauaucaaagcuguggaucacuuuuucuuaagauaucuaauuuuaacuuaaagcuaguuuuaaccauuguuuuugauauagcaauagagagaaauugccuuuaauaugacuuuuuucaaaaacagcuaaauguucuuaugcuguacuuuuacacuauauauuccucuggggguuuuauuuuuuagaaucugaauuaaaaaauuccauaguggauaaaaaguggcugcauuauuaaaaagcugguaaauguaaaguuuucaaggccaaacacagaaacuccaaaccagcugcacguuaaauuuuucugggauacuuuacaaauacagacccauuuuuacccauugaaaaccuguggaaucagaaucuugggacaugccuccuaguuaucuguauuuuuauaaaucucucaaaauaaugguucugcagcauccuuuucauauauucaugccuaggaaauauuagucuaguauauauuugagaaaguuaccagguuaaaauuuuuauuuuaaaauuuauuuagauguagcuucuuaaguggccuuagaaacagcuggcuagguuugggugcuuaugcuuauuuuguccuuuuuuuuuuacacauauuuuucugauuuucauagagacuguuuauuuguuugguggcugggauggaacacaagaucuugcugacuucugggcguacagugugaaggagaaccaguggacauguaucucuagagacacugaaaaagaggcaaguucucagacuuuucauacaucuauauuacagaaggggcguagaugugcacuuguuuuucggcaugauuauauucuucacuaaugucugucagcaguaguagcaauagaauuugugguaaacaaguuuuuuuuaaguacucuugaauuucagcuucuauaacuggcuguucagcuacugauacacaaccaaaucuguuuuauagagagagagagagugaggaauggggauuuuuauaucauuuuguuuuuaaacugcuuuagccuagaaauguaacuguguaacugucuuuuuugcuuaugucuccacuaccucuauucuuauuuuuaacauucaucuuauuuuuauuucuucuggaauauuguguuuuugacacucacuaucucccuauuuuggcuccuguuauuuuacuauaugucaguuuucauaaaugauauauauuaucuuuuuuuuggagucuugcucuaucgcccaggcuggagugcaguggcaccaucucgacucacugcaagcuccgccucccagguucaugccauucuccugccucagccucccaaguagcugggacuacaggcguccgccaccacgcccagcgaauuuuuuuuuguauuuuaguagagacgggguuucaccauguuaaccaggauggucucgaucuccugaccucgugauccacccgccucggccucccaaaguacugggauuauaggcgugagccacugcgccuggcugauacauauuaucuuuaauaaaaauuguauauauguaugcauguacagaucuguguaugcacauauacauaaagcauuuccauagugaauaagauggcuuagguuuauggcuuugaauuaagugcaugauuauauccuggaauaaaguaaauguuaauucauuuauuauuuuuucaaaucuuuauagaacauuuuaauugcacucuccauuuaaacuguuucaggauauaaagugacaaaugagcuauaacaaaacaguaggagccucaaaugaaaaggagauaaaacggccuaauucauaacccacugauuuugaucuaggaaggccauuuccaaagaucuagugcugugucguuaauccuggggaacuagguucuugcuuacucugaaauuauguuaauaaaaacuguccagggauuaaucacuggacaguuuuuauuuuuucaaauagauguugaaauucugauuuacuuuucuuaccccgggaaaguauguguaaguggccuuccuguuucaguauugaaguacuguucucugaaaugauuauuucugucuucaacaacaaaagacaaaucuuaaauuaaaaaaaaaacuaacuuuuuucuacuaaaguauuguaaaucuaaggcgaugacaucuguaauuauucuuguguuaagccuagguuucauccuaaaauccucccucuucuucagugaaugugucuaauuagugccuaagauccaacaguucuccaagugccuggcaugauccaacaggucauccaauaccacauuucaaaugucuuuuccucuccauuccuuuuagcaguuuuuucaacuuuaugguuucuuacgcuuuuuauaucuccauuguugaccuauucuguguucaccaacacagucuuuaaaaagcauauuugggcucggugugguggcucacaccuauaaucacaguacuuugggaggucaaggcaggaggacugcuugaggauuggagguggagacugcagugagccauuacagugucauugccuccagccucggugacagagcaagacccugucucaaaacaaaaacaaggccgggcacaguggcucaugccuguaaucccagcacuucgggagagcgaggccagcagaucaccugagcucaguaguuugagaccagccugugaccaacaugguggaaccccaucugcacuaaaaauagaaacuagcugggcaugguagcaggugccuguaauccuagcuagcugggaggcugaggcaggagaaucccuugaacccaggaggcggagguugcagugagccgagauggcaccacugugcuccagccuggucgacagagugagacucugucucaaaaaaaaacaaaaaaaaacaaccaaaaacaagucccccaaauaccauauuugauccuaugacaccucugcuuaaacccugugguuagcuucagccuuuguuucaguuaucguuuacacuguuuauuacauuacaagcacucaaaaaacuucaguggcauauaguaauaagcauuuauuugcucaugagucuacaaguuggcucggucauucuuuugguuuggccgggcucauucauuugucuaggagucagcuaucugucagcuggucuagugugguuucagcugggacugccuggcucuguuuuauauaggcuagccagagcuuguucucauggcaggugcugggcugcaaaggggaugaaguagacaugagcaauccaucaauuuuuuucuugcccugauagcaaaaagcaaucauguaaccaaguccagagucaguuggugcaggauacuauuaaagggcauagauacaggaaauuguaaauaacaacaacaauaauaaaacaauuuauuuaucucacuuccuuuugcuuagaguaaaaacucgaaauuucucaucaagauuugcuacucaauuacuuuuccagccucaucucccaugugccaguuaaaguugcuggaauuauucaacuuucucgccuguguccuuuggcaauguuguuuuccuuguuuggaauuaacagagggaggcucucccccuaacuuuaccuaauaaauacccacuuauucuuuaaaacucaguucagacuucacuuucucuguaaagccuuucuugaacuugccaagcagaauuaaaagcuuccuuugaugugcucacuuaaccccuuuuaauacuuggauggcuuacuauaaugauugguuuauauucauguuucccuaucugaauuccuuaaaggcgugaaucauauucuuuaaaauguauguauuuuaaggaugugcacguucuuacucuuuagugaguaaguaggugagguaaguuaaaugagaaauuaauacuagagaaaagggaacgauaaauacaaaauccagagaggguaggggguuuaaagguaauauuaaauguuauucuucuaaagcuugguauggguagauaacuucauuccguuauuuuuuuauaccauauacauauguuguaaguaauauuuauaaugcaauaaguaauuauuuuaaaacucaugcuggaaaaauauagagauuauuuugaugagaacacuuucuguuaguucaaagucaguacagaugaguaaaguggugauucaguacuggagcucagauuuauuauaguuaauuaauagacucauaaaaaccuccgccucccggguucaagcaauucuccugccucagccucccgaguagcugggauuacaggugccugccaccacgccuggcuaauuuuuguauuuuuaguagagacaggguuucaucauguugaccaggauggucucgaucucuugaccucguaauccacuggccucggccuccgaaagugcugggauugcaggcaugagccaccgcgccuggcccucaaguggcauuuuuguauaguuuucuaaaucucuuuaauguuuggcucaauaaaagacaucuggauucauaugcuucuuuauucaguugcuguaucagaaagucauguagccucuggaaauguucacauauacucauaagagaauaagagugaaaagacaaauuuuuuuguuagucauguaaaaauaacuuugaccuuauagacucccuugaaguaccuaggagaccccagaccacacugagaacugcugcuuuaaucuaauccacaguuccuauucagauauagacaauuaucccaauaaugccccaguaauguuuuuuauaggcaucccuugucacucugcaaccccagcccagaauuuagaccaugaucauguauugcuuuuuggugucaugcuucuuuagucaucuuuagucuagaauaguucccuaaacuuucuuugucuuucuugacuuugaugauuuuuaaagaguacagggcaguuguuuuuuagaguauccuucaacuggguuuguauguuuucuuaggauuggauuuagaugacauauuuuuagcaagaauaacccauagaucacauuagcaucuccuccauauaucauaucaggagacacauuacaucaguuugucugauauuagcuucaaucacuugguuaaggagaugcccaccagauuugucuaauuuauaauuaauaaguaauuuauauggagacauuucaagauuaugaaaauaugccauuacucaucaaacucucacccuuuuaucauccauuaaugaaacuuaaagcuuuucccaaaaugguuauaccauuuuauacuuugccugcaauguaugagauuucugguuacucccuaucuucuuggcccauugauuugcuuuggcaccuuggccaaaaaucaauugaucauguaaguauauaucucuuuuuguacucuguucuguucuauuauauuuuggucucuucuuaaccaauaugacacucccucgauuacuguagcuuuauaguaauucaugaagucagguaauauauaaauuuuagaaucaccaauuucuagaacuguugggauuaugaugggaauaugauaaaucuauauauuaauuuggagcaaauugguggguuucauuuugucguuugaauuuuuuuuuuuuuuuuuugagacagaguuuugcucuuguugccuaggccagagugcaaugaugcgaucucggcucacugcaacccccuucucccagguucaagugauucuccuaccucagccucccgaguagcugagacuacaccgaguagcugagacccaccuggcuaauuuuuguauuuuuaguagagaugagguuucaccauguuggccaggcuggucucgaaauccugaccucaggugauccacccaccucaacuucucaaagugcugggauuacaggcaugagccacugcaccuggcugcaaauugguguuuuaaugauauugaaucuuucuacaccaugaacaugguuuagucuccauuuauuuuagucuucauuaucucucagcacucuuaagaguuuucaguuuaagaggucuaugauauuuucguuaacuugauaucaguguauuuugcuuuuugugcuauuauaauggaauuuaaaaaucuuuuacuuuccauuuguuggcugguaauauagagaaauacaauugguuuguuaauauugccuuuguaucaugucacuuuaagucuacuuauuucuaauagcuucuuuuuuauuucuuagaguauuuuaaagaagcagucauuuuucuucuuucuguucucuuuuccuucauuauuuuauuuuauuuuuuguuuauuuguuugagacagagucuuucuguugcccaugcuggagugcagugacaugaucauggcuugcugcagccucgaccuucugggcucaagcaauccuucuaccucagucuccccaguagcugggaccacaggcgcgugccuccaugcccagcuaauuuuuaaauuauguguagagauaggaucucuguauguugaacaugcagaggagucuugaacuccuuaacucaacgaauccucccaccuuggccucccaaagugaugggguuacaggcaugagccaccaggcccagccuuuauuuuauuuuuuaaugccuuccuuauugcacugacuugaacuuccagagcaauguuaaauauaaguggugagaaaagacaucccugucuuguuucauaucuaaacaggagaguguucaguaugucaucauuaagaaaaauuaaauuucguacauguuaucagauugaaagucuuucuauuccuauuuugcuaugaguuuugaucaugaauaggugaugaauuuuaccaaaugcucuuuuuacauauguauugauguaauuguguuuuuucuucuuuauucuguuaauaugucagauuauccugauugauuuucagauguaaaaucaacuuuacauuccugggauaaauaccuuuuuguuguaaaauauucuuuucauauauugcuacugcuguuugguaauauuuuguuaaagauuaguuuugucuauguucauaagggguccuagccaucuguaaaugauuucuccaccucuuccccauuucuuccuccuucuuccccuucucuuccuucuccuuuguaauauuauuugguuucaguguuauguuggccucauaaaauaagcuaggaauggaagagaauguggauaaacaguagaguuuuuuuuucccuugauuuucugaaaaauuuugucuaaaacugauaccauuuuuuccuuaagugcuugauauaauuuaccaguguagauaugugggcaauuaugaauucaguuuuucaguauguguaauuccuucagauuuuccucuuucaucucaugucaucuugguaaguuagguuuuuuaacaaauuaugucuguuuuaucuacauugucagauuuuaccuauguuuuugauaguauucucucucuuuucauuucuaggaagucuguaguguuaaucuugcuuucauuucugguacuggcaauuuguauuuucccucccuuuguaaaaaauuagucugccagugguuuauaauucuaucagucuuucaaagaaccaacuuuguuaauuuucucuauuuuuuuucauguuuucuauucuauugauuuaucuuuauuucuuuuuucuuggcauauaacuuggucaucauuuuaauauuauuugugcuaauuuaguugaagcaagaaguucuauuauucucuuauuaaaauuucaaguuuuacacucuaugcauuauggcauagauuuauuauauguuacuccgucuuuguuuuugagauuauuuauggaggcaauccuuucuuaaaucaaauuuucaccuuauuugcugaagauauucuuugacaaaaaauauuuuaaaauaaguuugaaaauaauuagugugaauauuaaaguguacauucacaucaacuucauugucaaaauacuguucuuccugccuaauauuccuucauuucacuuaauuaauacugcuagauuacucuucuuagaauacugccuuuuuauguuauaucuugcuuuagaaaccaccaguaguucuuuauugccuacaagaucauaaauugucuccucugucagucauucaucaggcuuucuguguccacuuuauacaucaauucuguuauuucugcaggaagaacucuucaucucagucauaacugcauagacuguauuaacaaguauauuuuugccuuuguuuuucuucuagaaaaaauaaucugaaauugugaaagagcccaguuuuuggcucugguacacaagggcguagauuugcuaucuuacuuccuaguuuugugacgguggacucugugaaauggugauaauauuuccauaugggguuguuauaaggauuaaauggaacacacacauacacaguaauaguguaaacagaacuugggaguuguuuaacaaacauuaguuuccuuuccuuucccccuuucagcuaauuaaacccuaugcaauugaaguucuuuuuccccgaugaacccuuuugacuauacuacaauauuuuuuauguuuuauuggguccugugauacaagugauaccagcuaauuaauuuauugauaauauacuguucuuaauauuauucccuauuuauuuacuguagcugugcuauuuauucaaucaggaaaauuaauuuugcaauguaaaggauggauaaagaagugauagacuuggauucuuauuaguuucugucacuagcuuauuaaagguaucauccuggucuuauauuuccuugcuaggcuuguauuuucuccucuuuaaaaggagaaaacuagagauuuuauuuuuuuuauuuuuuauuuuuauuauacucuuaaguucuaggguaccugugcacaaugugaagguuugauagauagguauacaugugccauguugguuugcugcacccaucaacucaucauuuacauuagguauuucuccuaaugcuaucccucccccugacccccaccccucgacagucccuggugugugauguucccugcccuguguccaagugauuaaacuagagauuuuauugauguuucuucuaauuuugaaauucacugauucuaaauauucuuggaguaccucuuuugugcuagauucugaugagaaauacaaaaauguucauaaagaccaaacaugucuuaaaguagauugucauguaauagagaauugaacucugcacaaaugacuaaaaugcagugcaguauaugguagaaaccguauagauguuauaaacagagugccauaagcugcaguguaguucaucucaucuuuccugguagauuuuaagcauuucuaagguaagauuucugucuccuacugcuuacugcuuuugcuuuccuuuagagaguuaagccuaguguuggacucauauugguugacuugaugugaguuucugagaaaccuuuuaaugaaagguaauaaaaaaugacguuuaauuuuucuauuauuuguucuuugauuuuuuuuugcucuuuauuuguuuauuuauuuauuuucucucucucucuacagaaugguccuagugccagaucgugucauaaaaugugcauugauauucaacggaggcaaaucuacacauuggggcguuacuuggauuccucugugaggaacagcaaaucucugaaaagugacuucuaucguuaugacauugauacaaacacauggauguuacuaagugaggauacugcugcugauggagggccgaaauugguguuugaucaucagguuugaugcacaguuaaauauaugauggaauuaaucagugcuuagugauucuugcaauuagaguuuauguuagauguuaugcugaguuguccaguagugcuuuccaugacaaauaucuauugacaguaauaauuguuguuucaguagguauaaaguuauucuuuaaauuuuuuucucuuguuuguugcaggguagaauaugaagaucucaggacauagacuguugauuuauagaaacuuuagcgaguagauggagcaauauuaggaaaaacaaauuuaguuuuauaauacauaugcauaaaucaacaauaacaacuuacccuuuuaauuauauuucuuauucuacauuccugugagaaauggaaaucacuuuauaaugaacuaggugaaaucuagagcuuuucuuccaguuagagugaaauauauuuuguuuuguuuauagucacaaaauuguauaaaccuagaggggaauuugacauacuagauuaaacucagcaccaauagaaauuauacaauaauguuguagacuagaagacugaacauagccucauuguaagccauuuuaauauuaauauacauguagcucucauuagccccaucauugucauuaucauuguuaccugucuuugaauacuuauuccauacaaauucaauguaggucaaaaaagacaguaaccauuuugaauuccauaagcaaguuuuuaccuggcucaacccauguccaaaguuuuuuuugauguauugaggagaaaaagacuucaaaaaucuauaacucuguauugaugaacauaaauuaucuaguauuugggaaaugggagguggugcuagaauuaugacaaaacuuaagugagaccuaaaaucuuaucuaggacauagaacccagggucuuuauuuauugugucuuuauagauuuuuguuaauuauuugcuuuuaaacuauccuauugccauauuucuauuaacauauaauuguuauaggagaaugguaaggagaggaagagugaguuaugccugugaaguuaagugguagguagaaaaucaaaacuaguauucuuggaaauacuccccagcuuaaauuuggaacuucuguuggcucuauuuaacugagcuccacagagcuaugcacaucccugcugacacccucaauguucuucacguggaaaauaagcaugccaagaaaaguuaggcugguucugaucuuuuaaaaacaucagcagauaauauuguuagggaacaauuuauucucuuguucccaaaugguuacguauuucuuuuacaaaagaugcugaugucuuuuuuuuuuuacagguugaaaaaagaauagcuuaggaguagcacauagagaguucuuguguguggccuuuguuucucuugacuuuuauaaaauaggauguuucuugaaagcugggugcuguuaaauaaugcaugguuuucaacugguuagaugguacagcagaacacugggggugaagaaacaaggauuucaguacuaauucagccaacaacuaucccuguaauagugagcaaguaaucuguauaauccugcauuugcuauucuauuucauacaaauaaagcuauaaguuagaacuuacacuuguaguguuuaugacacuccaaaaauagcuugugguguucaugacaauuuaggauuuaacacaauguucaaauuugauaaaaauaugagaaagcuauacgauacaaacaugcuuaaaagcuauuugccauuuuuaauuuuaacauauuuaaaaaauaaaauuuaaagacaucuggauuucuuaagaacauaguggcgguuuaguucucaagcuuuccuugauguugcuuugugugguuuuccaggaauaaugguaaucaagcaaaaagauuuaaacacacacacacacacacacacacacacacacacacacacacacacacacacagucucucucucucagcaaaaccaagagcuagaguaaaccuauaacucccaaugccuuguaaguuuagccagaaacaacuaaaauacucagaacuuuuguugaagcccacaacaguauaauagggagaccugggaaagcaaagggagccuagcaguuguaugucacagugagaagugucagggacagggcacaaauugcacccagggcagccacuagaagaaucagugaauuaacauguguaaaguacccagaaauauccagaggugauaugugucagaaagcauuauuuuguaaaagugaaggaaacacagugggaaugauggcuccuuuugcaauggccaguaagaaaccuggggagcucaaagcuugagaucagcccuguaagccagaugagagucauagaauuagagaagguauggcuucaccggaagugccauauuuugaaggagccauucaauucaguagcaacagaggaaggaguucuugagcgagaacauccaccuucuauagaaauccucugugaaguuaucugguccagggaaauucaacucaauuacauaugaaaaacuaaaaagcaauaaauaacaaagcuuuagagagacauucuaaagaaaaacaauaaaaagaaaaauaacaauaaaugaaaguuauaucccaguacauuaccccuuucagaaaugaagacuuaucuacaaagagcguaaagaagaauagguaaugaucauauagcauaggaauaagauaaaacaaagagguaaaaaugauuaaccagggaagguaggcagaggagagccaacauauauauauauaacuggagacuuuaaagaagaaagccaaaacaauggaaaaaacaaauauuuaucaauugaauucaggaacauuuuccugaagaaagauuuuacuccgcaugucaaaugggcauacuauauucagaaaaaguugacccaaauacuuaacucuaagacauauauuaauaacacugacuauaaaagauaagagaucauuuuauagcaaguagacaaaaugaucaagucaccuauaagagaacuaaaaugagacugguaucagauuucucuacaucuacuuucagugccaagagauaauagagcaacaucuagaagacauucaagaaaagacaguaugagccaagaauuuuauaucuagccaaacuguccuucaaguauaaucaguuuuuguggaaauuacuagaaaauggaaagugagcuagccaagaaguagcaggaaaaacuucaguugaagaauugaagaucucagcucauugauauucucacugggucaugaggcauuuuuggagguuuguagaagggagggugguagguuggacaacauuggauacuuagaagccuuuauagcaauaucuucaaauuuugugaggagaagauuauuuugaacccagccaaacccuuaccaaucuuguauuccugugaugaguaaaauaaagucauuuucagguucaaaaaauaauuuuucccaggaaaauaagugguuauccacuauuuugauuuuaaaaauuaaauaucuaacuccugacauaauaaaugaauagucuuuaaacuuuuggcuuuaaagauuuuuuuaagucuuugauggaaaagacauuaucacacagaguuuaauaaguuuacuagcuuuucagaaauuuuuucggagaguaaaaaugacaaaacaaaucaaaagcguggaaaucgaauauuaaaagguuucuugguuuaaacugguaugcuaggaagaacuaccaagauaaagauguuuauacuucagcccugcaaacaaaugagaauaaaccacaucaaaauuaagcuugaauauucucaaaaagaaagaaacucuuuguagccauacgaaguagaaagguaggggguugguaacaaagauuggccauuaguaugaaucugugaguuaauaaaaaauggaaauagacucauuuaaugugagucccuaaagauuuucagcauaguucccagauauuuggagugauugagucugaaguacuucagaaacggaaaugugacccagcuccaguggagcccucaacggaggcaguggauggggccaaacugaguuguuuucagcagugugcugauuuuaacuguaugaucauuuuaaaaaauaggaauacuuccagacaucuuuguuuuucaaccauguuuaccaagauuucacccuuggggaauagauuuucaucuuaauuuauggaagucuuugagaaaccugggaaauggcuaaugagguagaucuuuuuagugguagauaaaaauuaggagauguuagaaucuuuuuaauaauaacuacaguuuuuuaaaacaacauuuaaaauuaugaaaauagccaggcacgguggcucaugccuguaaucccagcacuuugggaggccgaggcaggcggaucaccugaggucgagaguucaagaccagccugaccaacauggaguaacaccaucucuacuaaaaauacaaaauuauccuggcgugguggcauaugcugguaaucccagcuacccgggaggcugaggcaggagaauugcuugaaccugggaggcagagguuguggugagccaagcucaugcuguugcacucuagccugggcaacaagagugaaauucugucuaggaaaaaaaaacaaauuaugaaaauagccuuuuguuuaaaaaaauacauaaauagcagaaguaaucugguaggagaauugaacaucaaaugguuggguuuuauuuuagcaaaacauagauguuuuguguacacaauuuauucuuuauguaaaugccacuuacguucaacagcuaauucccaacuuggauuuauguguuauuugaaacagaauuugauucuuauugucucgugacaaauggcuguuuucucacacauuuuuaugaaaaguuauaaucuugaguugaaagaauggaagaauaaagcuugacuuuuaaacaugaaguguauagcuuaauucaaagaaaauuaaauagugcuauguuaaaaguaggcagaguucuucacauuguagaagucagucuggagacuugauuguuguaaauguccuuuuguuuguuuguuuuacuguuuuguaacauaaucugaaggguuuuauaaaaauaaaugcagagaggugaauuuagcuucaccacucuuauuugcauaucugaucgcuuaguaaaugguaguaauauuaauaggaugcuugccuagaaugaaagaagggaauuuuuauaaggaggguaugaucacuauucacccagaauauaaguauucacucuuacauauaaaucaacgccucauguaucauugguugauuuugauaaaaauuaugcaauuucaagaaagcagaaagcucuuuauuccaacauguuuuuacccucacugacaaaaaugacaacuugaaaaauuauuuagaaacuugcauaugauaaucaggggugguauuuagugucauuagggacaaaguuuaggguuuuuuugagaauguaaaacuguacauguugguuuuguuuuagcacauaugacaggaacaaacuaaaacuauucaaucuguugccuuguucugauagauguguauggacucagaaaaacauaugaucuacacuuuuggugguagaauuuugacuuguaauggcagcguagaugacagcagagccagugaaccacaauucaguggcuuguuugcuuucaacugucaaugucaaaccuggaaacuucuucgagaggacuccuguaaugcugggccugaggacauccagucucgaauaggacacugcauguuauuccacucaguaagaacauuccguacauugcguaaauguuauuuugucauguauaucuagauaggaaaagaaguggugaaaucuaauucuuuaggaagagauuaguguagcaaugacagagaaagacaaaacuucuuuaacagugaacuguuugcuaauuaugagacucuucccaucaaccugguaauuccuaaauaguuacuaccuggcuaccaaccugggcaaucuuaugacuaauuucacugcuuauguagauuuuguagcuauguuccuuucuuaugccuuuccacuuacgucucuuaguaauuagaaggacaauuucuuacucuguucuuauuuucccuucugcuauucuccauuaaguacaaagaauuuaagauuugauuuuauagaauuagaauuuaaauguaucagcaauggucaggagcaguggaucacuugauuccagaaguuugagacgagccuggccaacauggcgaaaccccauccccaguaaaaauacaaaaauuagccuggcguggugaccugugccuguagucccagccucccaaguagcugggauuacaggcaugcaccaccacgcccggcuaauuuuuuguauuuaguaaagacaggguuucaccauguuggccaggcuggucuugaacuccugaccucaggugauccacccgccucugccuucugcgguguugggauuacaggcaugagccacuguaccuggccacuuucuugaugcucaaauuuuucucuuuggcuaguaggagcaccccccacaacauauuuauguaucuuuuuuuguaagagaaaaauuaaauugugaauucauacugauaugucugauucaaauaaaauauuuuuuaucuuaaugucuucuauuuuguaacuuuauaucuuuucuuuuuaccccgacuggagcgcagaucguagcucacuacagccuugaaugucagggcucaaaugauccucucaccuuagccccccaaguagcuaaaacuacagguguguaccaccacaccuggguuuugaguaguaguaguaguaguaguaguaguaguaguaguaguagaagaaguaguaguaguaguaguaguaguaguaguaguaguaguaguaguaguaguaguaguagaaguggaaguggaaguggaaguaggagacagggccuugcuguguugcccaggcugucucaagcaauccucucaccuuggccugcccaaaugcuaggacuacaggugugagccaccaugccuggccuauuuuugugucuuuuaagguuaaaauccugcuucauaacauuaguugcuuugucugucuauaauagcuuucacaguaaagaaaacuaacaacagaaucacugagugcuguuuaacguugcuuucugauuauuuuucuguuuaggauuuagacuucuagggauggguagucaaaaaguauguauuaaaaucauuagaaauacuauuucugugucugaguauaucuuuauauacagauagguuuauuuguuggauuuuuuuugcccaaauuuuagauuuuuuuuuugaguuaauuuugucuucuaauuaaauaaaagcauauacauuguucuaaagucaaaaccauacaucaagguauuauuuuuggagaggucuuccugcucuguuccugccacuauagguaacugucuuuuauuagguuuugguuuauccuuccuuuguuuuucaaaaaaagaagcaaucucuauucucgcucucgcuugcgugcucucucucucacuuuuccccucucucacauucucuuucccucucucccucucuuuuugucugaugcacagauauuccuucuucuccauuccuacacaaaggaagaaggaaccuguauauauuauucugcaccuugcuuuucuucuuuaacaggauguccuagagauccccuuuuagcaauauguagagagcuuccucuuucccuuuuauuccagcauaguacuccauugggaucuguuauaaaauuacuuuuguagagguuuaaguuuuuaaaggaucauucugaguucuucauggaagugauaaguuacuccuuucuuuuuuuuuuucuucuuuuucagaaaaaucguugcuuauauguauuugguggccagcgaucaaagaccuauuugaaugauuucuuuaguuaugauguggacucugaucauguagacauaauaucagauggcaccaagaaagacucugggauggguaagggcauugagugauuucuucucucaugucuuaacuacuuuagguagaaaacugcaguucauucucuuuucuuucuaaucauuuuucacccuuucuuuauuucuuuaauugaguaauuccaaguaagagaaagaaaauucuaccagcuuauucaguucuaucuauuuuuaaauaugggaauuacuauuuccuucaagcagaaaauaugugaauuucuaaaugaauugugugugugcuuguuggggggcgggguaggaagaaucaauaucuuaaaaacuuuuuauucuguguuugcuaauuuuuuucaucuucuauuuucacuguagugaucuuuauauuaggcacuagcauaguagggugugugucuuaaggggggaacuucaugggauugguaacaccuuguaaguuuaaaagcucagcaucuaggagguuauuaguaguggaauggcugguuugcuuagauuaugcauauugcccuggcauaauuauuaauagugcuccauucauuuucaaaaguguccuguuuugaucauuuauaguuacccuacauaguaguugcuuugccugugauuauuguaccuaaaagaguggcuuuaauuaaggugcaaugguuuaaaaugcuaauuugaacaauagagugagaaauuaaaucagcugcuuuucuuuuuagcuguugcuuauagauugguguuuuuauuauuggcucuuuugccaaauguggauaaaagcacuuguuucacagacauuguuucuggauauuuuauugauuaauacaagcuuccuuuaaaacaaaaacaacaaaaauauuuuuaaauuaaaauauuuguucacauuuaagaagaaaaacuuguuuuaaaacaaacaaacaaaaaaacaaaagauaggcaaggcacagucgcauaugccuguaauuccagcuaguccagagacggacaugggaggauugcuugaaucuaggaguuuaggaccagccugagcaacaaagcaagacccugucucuacaaaaaggagguuuccagauaaaaguagacucaauagauauguuaagcauuuggaagaaaaaucuguugaugaguauaaauagcaucuaauguaaaaaacgaaggauagggacacaacaggaaaagcgaaacuuuuuauaaaaaaggagacauuaucacaguaaauuucuuggcuuuacaguaagcaguauuucccuaaucauaaugcagaacuacagccaguuuaaccaaaaauugggaugaaauauagugggaagauaguguaaguguaguaaacaucuucgucuauuacaacaggaaauuaguagguaaugucuaaaauagcagcuuagcaugugauuuagaaauauggaccugaauagguaauaacauuauuuacccuaucuaaaauugucuuauuuacucauuuauuuacuguugccauaggagaguguagagcuauaugauuuaauauuugacuuucucuggcuuuuaagaguuauucuaacuuaccauuaaaauaacuaggagggucaggcgcaguggcucaugucuuuaaucccagcacuuugggaggcuaaggugagaggacugcuugagcccaggaguuugagacuagccugggcagcauaguuagcccucaucucuauaaaauaaaaauaaaauagcaggagagagguaauacuccuucuacaauccuaagaugggucucccugaaaaagguagugaagauaguaauugauaugacaauauguugaaaauuauggcaugcugacucagugcuagacuacggacacaguggauacaaggcaaucacagucucucaaagugcuuauaaucuagcuaguagguaauguauucccauggauaauaauuacuacucuuuauuuagacccuaccauauaccagaauaucuuuaauuggugguauuauucuaauguacaagaugaaaacaguuacacaacuacguaaugacagagcugggauuuagaaguuugagugcaaggaagguguuucugccaugcuaaacuacugcccaagauuaaaagaaaaaaguggcggccacgugagguggcuuacaccuguaaucccagcaguuugggaggccaagacagguggaucacgaggucaggagaucgagaccauccuggcuaacguggugaaaccccaucuauacuaaaaauacaaaaaauuagcugggcgugguggcgggcgccuguagucccagcuacucgggaggcugaggcaggagaauggcgugaacccgggagguggagcuugcagugagccgauaucacgccacugcacuccacccugggcgacagagcgagacucugucucaaaaaagaaaaaaaaguggcaaugcgugauagugacagagaacuaguaaaauaaaaauucaccaugacaaguaggcuuuaaugacugucauucaaaacaauuuuuuaaugaguuaaaauuauguaguaauguacaguaucgacaauuauucuucaaucaugguuauggcuagcuuuagagcaguguggcaauuauucuuuuuauuuaauuuuguuguggucauaaaaguaaaaauaugcucauuguagagaauuugaaaaauaagaugcaaaaaagaaaauaugucaaacuguccagagauaacuuguuaaaauuuugauauauuucugucuagucuuuuuaaaacuuauuuauuguauaaaaguugauacaaguuuguauucuauuuuaaaauuuacauuaaauugugggauuuuuuccauuauugugguuuuauuaaugugaacuggagauguuauuagaaaagacaaauggauucauuguuugauuacugcuauaaucaauuuuucuaaaaucaaaaucaccauuuuuuacuguguguguucaguguguaauugguuuacacaauugaauuuucccacaaugcaaauaaauucauuaauaauauuuguugaccaucuacuagcaucuaaguuugucccucucccuuccuccuucccuccccacuuaguucauugucuucuguaggcccaagauuauuuuaggcacuugggauucaucuauggaccuggaggauaagauccuuucccuuagaggacucacauucuaguggagagagaccugcaguuguguucuaaguacugugaauaaaauacacuggaugccgugauaaugaauaacaagggaagucucauuuaaacagaguagguugggaaaccaucuuugaggagguaaucuuuaagauuuaagaugaaaaguagagaauuaggaagaaccaugugaagaacugagagaagaacaaguacagaguucccaaagcaggaaggaaccugggauguucagaaauagugggacugguacguauugaggauuggaaaaguugguaugaaacuagguuagagcuacggagauaagagucagaguauuuagugccuuguuacaaaugcaaggaguuuggauuuuuuuucugaauaaaauagauuauucaaagguuuaauaucagugucuugaucuaaguuuuaacaauaccacuucuuugucuagguguauauuuuccaagugguuaauuuugacaauguuccugugaguugcauuguucaaaggcuuguuuacugaggauuuuuauggcaggguugagcaucugguuagaauuacuuggaaaaauuucccaccuaaaacuguugcaguuauacuuggaauugaggaaccucagugacucuguuagcacauuagagugaaauggaaauuauucucuuuuuuucuguuuuuuuuuccccucaucucugccucucucacuuucuuccuuuucccuccuucccauucuuuuucccaugucccuuuuacuccucccccaacuuucucucuccuagaggauucuaauaugcggcugggauugagaaccacuguucuagcucuccggagucuauuucaguccuuaguuaaccuuaagcaaguuaccuaaugucucagcuuuugcuuccacauuuguaaaugacccaaauuagauuuuaaggaaaauagcgucucuguccauggcuacccuaggaguagagauggguuaacccucuaguuucgacugguguuacuguugggugccuuaauuuucacaagaggauguuaauacugcuacccucagguucacuaaucuagccaguuaacaucaagucaugccaauuuugccucaucuucucucuauucccauugcugcuucacuaugaacuaguuugggcuaacaucaccuauuuggccucugucucuagacuuccucucccuauguaccccucccugcaacccauucuccacacugcaagcaggauacagcuauucuguguuaccaguaaagaauagaaccauaugccuuaacauuuauagagcagauauuuuuuggucaccuacuaggugccagacaauaagcuacgcacuaggaguacaacugugaaugagggcccuaucuucauggaguuaugguuguacacagagaggaaaaauaaagugacagccuuaccuuuagauuagugcuagugaagaaaagaacauauuuuuaaaaauacaaaccuaguggguuuucuuccucacuuuaaaucuuuuaaugguuucucccugcccucaggauuaagucuaaacuuaacauaauucacagacucuuuuaugaugugccccauuuuaguucuccaguccuagucuuggugucuguacucuucuugccaccaacucuguuucacgaccaccgaauauuaaaucuuuauagauaguguguuuuaacuugccuuugagaguugcccaugcuauuccuccuaccugaaucacuuuccucuccccuccaaaaucuagcuaacuuguacugcuuaccucucagaucuuagcuuguagaucguugucgcccaaaauucucuaaugccuuaagcccagguuagaaauauaaaaacauguggcucuagccaucauuguuaacgcaauucuagguauucaucuggcuguaaaaucuugacugugcuuuucaaaaccuauacaaagaucagcugaaauacacagacuuguucaugauuucuuaaagagcauucagugguuucaguacucuagaucuccuaaaagucuuuuacugaacuaaauuagacuguucagaaaaccucacaucagaaccaugguauauuauauuguccucccauagaauuauuuuaccucacuuuuaaaaaguacauuuuuuucucucuuacuagauuuuuauuguaagcagugaaaaguacuuuuaagaaggcagaauacuauuuaaauucccacauuuuuaaaauauucuuagaaaacaccaauuuuauccauuauguagaugcucuguagcuuauuaaucauucuguuguuuguuaacuguuguucuaaagauuuuuuacuacaguuaauuacuguaauuugagauggacuuaacauauaauuacuguguuuaucugugauucaguaauguggcuuauuugauuaaaauuauauuuacaaugugaguaucaaaugggauuguuugagcucauagaguaaauuuguuugaacuauugagaucaccgagaugguauagcuaauaguaaaauuacugcuguuuauauaauucuguauugucagauacuauaaaaucuuaaguuguugcucuuuauaauuaucugaauguaccaucuuagauuuaacaucugaagaucugaagaaacuuuaaugcuuauuuuuaaacuacaguguaacaauuuuaugcucuccucagaagaaaauuauaauuuaaaucaauggauuggcagcugcuuuaagggauuuauuagcauugugucuaauacauacauaauuacaucaaaauucagcauaucuaaaacuugaguuuauuucugagaaacuuuuggcaaguaagacugugaacacaagggguuuagcagauuccccauauguaagcucuguauuuaacacuaauugaaacuuauguguagaagauggucugucacaccaccagaguuuuguaguuuucuauagaaacucagucuacuauaguaagagugcuuucuccuguucguauucauucaaggaagaagcauauauugaaccuucuucauuugccaaaugcuaagucaaguauugguaauacugaggucuuacaaccugaugcuuguucuuuaguaguuauguauuuacuuguuuugauuuuuaaauuguguccacucuguuuucccacaucugccauuguuuauuccauccuguucuaaccauuauagcagauugguaccauugaaagaauagcaaauugagaaucagaagacuuggucucucuuugucugggucugccacucaucccucuguaauucuagaaaaauuauauaacuucucugaaccugauuauucaucugaaaaugaggagauuggaccaguugaucauaagaccucaucuagcuccaaaauuuugaaaauuaaauuucauucccuucugcuguuaucaggcugugaaacuaagauaugagggcuaugugaguuuacaucuacagaacuugauuuaucuauaaauaaauuuuuaugaaaaccuuaaaagcaaaaucauacugauuuucauuuuggcccugggaaugugcuuauugugcuuacugacauuuuaaaaaauuaguauggucauaacucuuuauguuucugauccuuuuauacuuuuuuuuuuuuuuuuuuuuuuuuugagauggagucccgcccugucgccaggcuggagugcaguggcacaaucccggcucacugcaaccucugccucccggguucaagcgauucuccugccucagccucccgaauagcugggauuacaggcaugcgccacuacgcccagcuaauuuuuguacuuuuaauagagacgggguuucaucauguuggccaggauggucuugaucucuugaccuugugauccgcccgccucggccucccaaagugcugggauuacaggcgugagccacugcacccggccgauccuuuuauacuuuuaccaauuaaaugaguaaagccaaacuggcaacacagagaagacuuugaagcugaugauuugcugucauuaacauagauuaguuacuggacuagaaaaugguagcgcuuauuuucaacauaauuaggcuucauugcugucaguuuaguauguuuuguauuugaugugucauuauucaaacagaguaucuacuuuuugccucucaaaauuauugguaauaauaacuuucccugauuucccccuucuacccucccagggguguuuuugcuaguuacaagcuuacaagaguauuuuauauuuuuagauaugauauuuagguuacuugauaguaaaugagaauuaaaguucacauguaaaaacaaacaugcaagaacacuaacaacaauuuugaaaguuaaugaaguaguacuggcacuaccagauauuuauaaagcuacaauuugccaaaguacagacuaaugggaugaaauagagcagauaguauaaaaauguccccaaauacauaugagaauuuaguauaugguaaaguuggcauuuccagucagagagaaagaauagauuaaacaguauaugacauggagacauugcuuaagacuuggcaguauuuuaaaaaaaaggaaaaucugacuccagccugggcaacggcaagacucuuucucuuuaaauaaguaaauaaauaaauaugaauaaaugggaaaaucuggaucccuacuugacuuuuguacaucaaagaaaauucuaggugaacuuaaguuucauacuuaagaaauaaaauuauaauuccaauuauuuuuaauaaucuaggauuaagagaagacccuucuaaacaugccacaaacccagaaaucauaaagaaaaggaauguuugauuuuugcaaaauuaaaaaauauaaaaaauuguuaaaauaucaaauaaugacaaacuagcaauuaagacaaagcuuauuuccuacaaugaacaaaaggcucuuauaaaccaauaaaaguggauaauccuguaguagaacaaugacaaauuauaugaauagauacuucgaagaaaaaauaauucauauugccaguaaauuuacacauguacagaugcucagcuuuauucauaacuuuuaaguguaaauuaaaaaaucacucagugaauguugguauggccaugaggaagcaggugucuuacauucugguugaaauguauuugguacagccuuuuuuuuuuuuuuuaacaguacuuuaucauuaucuguuaaaauacaaaaaauauauuuuuuugacuaagcauuuuacuccacgaacuuuuccuacucauauacuuuuauagauccacaaaaaauaagcuauacagagauauuuauuguaguauuguaugcaaggagaaaaaaucugaagacggauugaccaucaacuuauuugauuuuuauuuauuugauuguccaccaguaaauaaauugguugauccauucaaagaguucaguuuuuuauagcuuaauacagcugagauaaaucaguaaauauuguugagugucaaaagcuaguugcaaauuuacaaaaaauaaaugaugagugguagaaagauucaaguaaaauaauagaaguuaguucugaacuggaguuguugcuagugcuuaauagggccccauccaacauuuaaaaugucccaacuuucaaagagaaggauguggcagacacuguuguuugcuuucccaaaagucauuggcccuuucuucuguuaaccaaaccauaauuuuguuuaauggcaaguugccuaaccccagggcaugaaugguuaaucaugauuagucuaaaccagucauuauuauccuuuggcaaauuauuucacuuuaccuuccucccaugugacacaauucuggccaaugagacauaaagaaagucuacuggaggacauuugacaaaaaugucuucccugaugacaguagagagaugcugaaagaauucuuugccucccugcuuugggugcucuauauaaggaugugaugcuuagaguugguauuggcaaguuucaaaaaugagaaggcggccaagaaaauugcagaaaguuaaccuagcaccaugauuugguugaacucugaaacaaucuuggagcugucuacuugcaaaauuuuguuacaugagcuaauuaaucuacuguuaguuagguuuucuguuacuuggagcugaaaauauccuaacaaauagugaauuuguggaaagcuauuuuuuauuagauucuguauuucugugacagcucugaaaacuguucuuuuccuuugucuuagcuaaucaguaaugaauaugugcauuggaccgugaagcaaaaauagaguugagauuaauucauaaguuaaugcaauaacauaucuuccucaggaauucaaaggacuucgaaaauauuuguuaacuuuuuuuuuauccccccucccacaggguuucuuuauguuaaauauucugacaaucucucccauuugcuuagaggauaaaccaaggaaggaagagaaaagaugugauucagacauauagauaaaauuuuuuuacuuccccuuuagcuguucuauuuugaguuuuaaagauguuaaagaagaaauagaguugaaggauuaucauuguaacuuccuaaaacaauuauaaaaauaacgaguuggcagugauaauuguuguaucauucuuauuuucuguuuuuuucagauaaauguucuuucaaaauauguuaaugauuaacguuuacugaucugcuugauuaauuuuucuuugugagucaguuucuaaacugguuaagguuaaagacugguuaagguccuggcauuuaguugagcuuuuuagcaguugaaucuuaaaguuuuuaaaaucguuuauguugcaggucuuuuguccuucccuccucccccgcaaauauacccauuagaaacuguuaaauuggccaggcaugguggcucuugccuguaaucccaacacuuugggaggccgaggcaggcgaaucaccugaggucaggaguucaagaucagccuggccaacauagugaaaccccggcuguacuaaaaauaaaaaaguuagccugguguggugaugcacgccuguugucccaccuacucaggaggcugaggcaggauaauugcuggaacuugggaggcagagguugcagugaacugaauucacauuauugcauuccagccugagugacagagugagacucugucuccaaaccaaaaaaaaaagagaaaagaaacuguuaaaaauugaaaagauagccuuguuuucaucuugcaaagaaaaucaguacagaaaacuauuaauaguuuugccauauuagaaugaaagcugcuuucuugguuuugaccuuuaguuuuuuuuguuuuuugauaaugccguuuuuauuuaaccagccuucauuuuuauuauuauaauuauuauaaaaguaaugcaguucacaugaucaauaaagcaaaacucaaauaacauagaaugcuauaaaaugaaaaguacuucugccaaaguagcaaacugacacaggcugcugauucccuuccccagaaucaacccagagaaauaaaauugagagcagcuggauuccagaaacuccuuaaauaagacugaaggcucacucucccccagauuacccuucaguuaauuuuuacccuuucacuauagaaacuagcagcgguagccuagcccacuagugucagaauucggugggcaaacauuaugucagugcagaaacccugcuggaguucagaguugaugaaaacauguggacugaccaucuguucucaauaguucauuucuucuucucuucucccuuuguccagggagacugccuucuccuuccucuuuaaacccuugccugaaggguuuaaagguacaaaacuguugcauaggggcgugaucauauauggacaugauucuugguucuuugugcuuaugcuucagaacccuaugacuuuuccucucuauuuuccuuaaucucuaccaguuaaggccuggccuuugaguccucuccaauauaucuuaccagaaagaagagcugauucccugaaaaacauuaccuugcauacugauauaacuagacaguugaggacuacaacugucucaaaaaaaaaaaaugaguaaacuuauacaugauguaaagcagaauuauuaaaacagaugaacggccaggggugauggcuagugccuguaaucccagcacuuuuggaggcugaggcaggcagauaaccugaggucgggaguuugagaccagccugaccaacauggagaaaccccgucuccacuaaaaauacaaaauuagccaggcaugguggcacgugccuguagucccagcuacucgggaggcugagacaggagaaucgcuugaacccgggaggcggagauugcagucagcugaaacugugccauugcacuccagccugggcaacaagagcgaaacuccaucucaaaaaaaaaaaaagaugaaccaagaauuuaaaauaagcaugaugaauacacuuaaagauguaagagaacacacuaguaauaugaaauaagauccaaacauuauaaaaacagaaccauacggaaauaguagauaugaaaaauauaaugaaaaugaagacuacaacaaauguaaguaggaugguaugagugaauuaaucaguuggaagauuagcaagagcacucuuccaggaaaaagcgagggaaaaaagauaaagaaauagaaaauagaguagagaaacuaagaaagauagagaauuguuguacaagugccaacaucuuaaaaggaauuccagaaggaaagaaaaauaaaaauuuaagcccgggcacgggggcucacaccuguaaucccagcacuuugggaggccaagaugggugaaucaccugaggucaggaguucaagaccagccugaccaacauauugaaaugcugucucuacuaaaaauacaaaaauuagccaggcuuggcggcgcaugucuguaaucccagcuacuugggaggcugagguaggagaauugcuuaaacccacaggcggagauugcagugagcugagaucgugccacuggacuccagccugggcaacaagagugaaacuccaucucaaaaaaaaaauguaggugaaauaauuguagaaauaauggagauacauuucuuaaaauucaaaaauggugaaagacuucagauuggcgaaagagcucauaguguaccaaauagaacaaauaagggaaagcguuauaccuaagcagauuaaaguagaauuaagaauagcagagagaaaauucugaaagauuucagagagaaaaagcagaugaccuguaagggaacaagaagauagacauuugacaguugaacagcaauguagaaugagaaaaaacgauaaaguuuaaaaguagccaagaaaaacaacuuugaaucaagaaauuuaaaucuuccuaacuuugagaugugagggugacauaaaauauucucaggcauauuugccuuagcacauuugccguauagauacccacaguagaaacccauuugggagcaggacucaaugaaaacuaaaucuaagaaaugcuagaaguaugugauaaaugaugaucaaaauuuguuguugccugaagaaaaacacuaggaccaauauucuaggucaaggaaccauggcggaaagggaaaauuggacacuauauaaauucagguauugugauuagaauauagagaagaaacuauucuauauuauuaacacuaaaaugucauauacaaggcucaagaguuaauggaucuugauuuucuuucuaacuuccuuuuccugugucauguaucagugccaccgucucuuauaucucaugccaucuucuuucuuggauuccuuuuuuuguuuuguuggaauaucuccuuaaagaaguuuauauacauauauauauauauguagucauauguaugaacuuuaaaauucucuuauuuugcccucguuaagauugcuaguuuaacuggaaauggaaaguuaguuccauaucuuuuuauacuucucagaauuuuaaaguuguuauuccauuguauucuagcauucauuguuacugauaaguuguagggccaaaagaguugugauacuuuuccucaacccuuuuaagagucaugguuugacacuccuauaauaaaagacagguuaacaaaagaaagcauaacaaauugauuuaaucaaaguuuuacguggcaugugagccuucagaagaaaugacccaaagauacggggaaaacuguccauuuuuuugcuaagauuuaaugaagaaugaacagcugguuagaaauaugauuggguaaaaggcuaugauuuaaugcagguagacugagguggggaaacccaacaaggcccgucuguucagauucuucuuggccccucuguguaguacuucuuccuccugggaauggggcaggacccugcuacagcaagggucuugugaccuacuaucagacaaggguagaucacagaauuucuuuauggcgagcuccuagacagaaaggcagaggaaaguuggaucaguaauucuaguuuuuagaauuuaaaagucuaggcugacuuugggaaaaagagguucuaguuuuuaugacccaccuugaggaagaggaauucugauuugaugacucacuucuagggagaaugagggaagacaggcaggagggcagaagaaggugagaaagaacuugguucugaagcuguucugaggccuuccaguguucuuuaguucaaaguacuuagcaugccagaguguuuguguucugagccccugacaaggucuaauguuaguuugauuuuuauuccucuguauauaauaaucugcuguuuccuucuuuggaagcuuuuagaauuuuucuuuucuucgaguuuuaacauuucauauuaagguggagauguacaucuauauaucuacaugccaucuuuuuaaaaaaaaaacaacauagauauaugugugcaccaucuuuuuaaauuaaacaugccuagcuugcagugggcucucucaaacaggacacccaguucagggaaacuuuauuuuuucuucuacauuauuucuucuuuccuucuggucuuuuuuucagauaauuuggcuucgauggguauauccucuguguccuuuaacuuuucccucauaauuucuaucuuuuugcuguuuauucuggugauuugucaguuuuaucuagagaccacugacuuuguuucuaacuaugucuguaguuucauucugucauuugaauuuuuuggucauaguuucacuuuuuaguaucuuuucauagucccugcuccuuuuuauggcagcuuauucuuguuuugcacaugaaauauucucuuuaaucuccucaaggauacucauaggguuuuuuuucccccaaguuauguucuuuucugugauuugucuuuuccugguuguucuauuuguucaucuaggucccucucuuuuacacuguuaauuuuuuuccuccugucuauaauucaugucuaaacuuuaacauuuaugaauaaaggacuguaucaauuaagaaagguaguuaacagcaguuucuuuuacaguguguaggucucuuuuuccaguagguuucucucauaaaugagacacugaucaaggucuuguauaagugcacagcacauacugucaaccaagcuuuccuauagaaugcguaagcugagaauaggcacacaaguugggaacauauaugauuaacaaaguaaagauugggaguuacuuuaagcucugcucucauucuuauuuacgccccuauguccuuauuagaagcucuccacagaagccuuccucacaaucuacuucuucucuuuguauccgaugacuuauuuggaaguuuuucaucuuuuaucucuggugaguuacaggcucugguaauaauuguaggugaaaacagccguagacaacauguaaaugaauggacauugccugauuugacccugagcagggcagaucaagccauaguuugccaagccauguuauaaaauuuuuaauucaaaggcucacuauuaagacaaaauagaauaaugaaauuuaaaugcaauaaauuuaggcaguuauacccuucacuucuaccacuuacgaaaguaauuccaguucuuuacuguuuuuaucuuccaaaguuaucugaggagcagaggucagaaccugagcacaucacuucugaaaauuuaccaugccuuauuaagaaaauacaauugucccuuggcauccuugagggacugguuccaggaccucucuuggauaccagaauccucagaugcucaaguccgugauaugguguaaccuacgcacauucccuccuauacuuuaagucauuucuagguuacuuauaauaccugauacaauguaaauaguuguuauaaggaauaaugacaagaaaaaaagucuguaugucuucaauacagaugcaaccauuuauggguuuuguuuuuuguuugcgguuuuuuuuuuuuaauacuuuaaauuuguagugguuugaauccuugaacauagaacccagggauauggagguucgacuguaccagacuuuacauacacuaaagacuguggcaugaggguguaggcuauuauuaagaucagguugauauauguguguguauaaauauaaauauuguguauguauguauacaaauuguaugguguguguguguguguauaauuuuauaauauaguuacugugaaaugcauuuggauagucuuuaaaaugucccaaauuuguugaauaagaauguaaaaggacaugaauuuaagguagacuaggaaaaaauaaauacuggauuauuuggucccacuaaaguagauaaagaagaccaagaucaauauggcuggcaucuccugcaauacauaguauucuagguugacguaaauauuucacuucaaucugauauuuguuuagcuuuuugagcacaugauaauuguucauggguaaaagaaauguuaaaacaaugacauuguuuuagaucaugacaauuauguugugaaguagcugaguucauaauaugcacuuuauguauaugaaauuauauuucaaacauuuucaaauaagaauaagaaaauuugucauuugccauaucaguguuuuacagauuauuggguaaugcaaagugaucaucauuuauuuaauagauuucuuauaaaaauacagcauuauuaacuuuggggaguuuaagccacucaaggaaacaaaauggcauauuauaccccagaauuuuuauuuauuuauuuauuugcuuuagagacagagucuuacucugucacucaggcugaaguacaauggcaugauaauagcucauggcaguuuccaacucugggcucaagggauccucccaccucagccucccagauagcuagaacuacaugugcacaccaccacacuuggcugauuuuuaguuuucauagagacagggucucacuauguugcccaggcuggucuugaggucauggccucauaugauccucccaccuugaccucccaaagcacugauauuacaugcacgagccacugcaccuggcccagaauauuaaauuuuauuuuuggaaguuauuauaugugaugaacagauauuuuaaaugacucugaccuuauuaagcaacgcugcguuuuaccuuuuaucaaauuuuuuuucccaggucaagauuugaauauuuaaucucuacuaucaaauuagaacugucccagauaauaaaucaguuaauuaaagcauuauccuuuccuuccuuauguaaaaaugauuauauugcauaccucuuucugcuucuuuuuucccuguagcuggcaauugacauuuccuuuagucuuuccacaaaucauuuaguaauuguuauauucaggcacuauucuagacacugggaacaaaauagugaacaaaacagccucuuuccuuguggagcucauagaguaaggagaaggcaauauauaauuguuuauuguuuaguuaaaaaguuauguaguguguuagaaguuaaguauguggacacauaaagcagaauaaagguguauugaucuuuucaagagaaacuaguaggggcuggaugugguggcucaccuguaacaccagcacuuugggaagaugaggcaggaauauugcuuaaggccaggaguuugagaccagccugggcaacauagcaagaccccaucucuacaaaaaauaaaaaaauuagcugagugugguggugcaugcuuguagucccagcuacuugggaggcuggggcaggaggauccuuugagcccaggaguucuaggcugcagugagucaugguugugccucacugcacuucagcuugggcaacagagugaaaugcuguucuuuaaaaaaagaaagaaaagaaaggaaggaaggaaggaaauacuaaucuaucuaaugugaauauuuucaucuuauuuuuuucuuuaauuuguaguuccaaugacaggauuuacacagagagcaacuauugauccagaacugaaugaaauacacgucuuaucuggacucagcaaagauaaggaaaagagggaagaaaauguuagaaauucauucuggauuuaugacauugugaggaauaguugguaaggaacucuugucucugcugcaaucccaauguaauaauuauuugagguuguugguuuauucaaaaaagagagaaaugagaguauuacguuaauuugugacauuguauauuuaaaagucaguauuggaaaaaaaucaauaucgguaccuauguauacaaugauguucagugaauggauuuuaccucuguguuuuucaaguaguagaugguuccuggccugggacucaagagaauuguauuuuagucuagguuccguucucaaguagaugugugaacuugagaacagugcuguuucuuuaauguucccagaucuuaguuuucauaaaacgaagaggcuugacuauagcaaggaggggacaguauuacuuagcauuuccaaaccaugacuuuugugucauagagcaucccacagaacuggugcugcacauuuugcuuugggaaaacauggauccagcucugacauucugugauugcuccauaagugaauauugugcagaacagaagcacuucagagagcuucuccauucauaauggggaauagugcucugcagcuaaggaauuuauuauuuucuaaauaggacauuuauuuacagucaaaugacagcaauguauacuguacauuuuuauugugcauacauagacaagauagcaucucuuucagucuuuaguuugagcuuucauguaugcuguuuguauuucauaacaaaaaguaggauaugugagcuauuuacuggacaucaaaagaacuuuagaacucaguucuaacaaauuccgauuguuuuaugaauaacuagaacuuuaagauacgaugugaacgcauuucuaaaauuuuuuguuaguaauuagacaugcaguuaauuugcuugcuacaguuguauuaucuuugcugcuaauucucuagaaugccuuaaaagcaaugucuugcaggucuugugucuauaagaaugaucaagcugcaaaggauaauccaacuaaaagucuucaggaagaagaaccauguccaagguuugcccaucagcuuguauacgaugagcuacacaagguauccuaacuacauugaccuguaaacuuuccauggccuacuaucugaaacaauccccaaauauaucuuugauuguuuuaaauuggauuugaguaaaaaguuaaaauacauaguagacauucaauagaauaacaaacacccaauaucacuucucccuaaaauuccuuaagagaauaagcauuuuuacguagucuguaauucuugguacuuuuccuuuuuugaaaauagucaguggcagcuucuuagcuguauagaucuagauacaugacauagccuauuguuucuacaaugugacuauccaaguaaaauauguacaguugucagcauuuagguaccuuguuccgugauauaacaugguuuuugguuuuagauuuuccuauugugugcgaagucuuuuuaaucuuaauuuuccugauauacuagugauaccucuuuuaaaucagccuugugaaaugguccucuguugugaauuuuuagugucauaguguugagaguucuuucuuuauuucugucuuaaacuuaaccauguacuuaagugauuggacuuagauuacauaguaaauuacugacagagaccaauucuuucuguuaagccauggaugauuuauuuaaauucuacgcaauacacuuugagaccuuuagguaaaagauaacaugggagugaguaaaagcccuuucuuuuauaaccucucaauuuaaggaguaaaugaauuuccauccauaggauagagauaauaacuauuauauaacaccaaugaauauaaauguuuuuaaaauuuuaggaaauauuuaaauuuaaauuuaauaaauguauacacuaauuguaauuaaaauauuuaaauauuuaaaugcuuuuguauacauacagaaaaacauucaagugcaauaaauuuaggcaguuauaccucucacuucuaccacuuacgaaagugauugcguuucuucacuguuuugucuuccaaaguuaucugaggaacagauaauugauuaauguaauagugaaaucauuauaaauuccuuuugcauuucauuuuugguauugaauuauggaauaauguuuuuaauguuauuucacaaauuauaugugccauuuaauauuuggcauuucaguuaaagcaaaauuaagauguuaaaauuuuuuuuuuuuugagacggagucucggucuguugcccaggcuggaguacaguggcgcaaucucugcucacugcaagcucugcccccuggguucacaucauucuccugccucagccucccagguagcugggacuacaggcgcccgccaccacgcccggcuaauuuuuuuguauuuuuaguagagacgggguuucacaguguucgccaggauggucucaaucuccugaccucaugauccgccugccucggccucccaaagugcugggauuacaggcgugagccaccgcgccuggccuaaaauuuuuuuaaaguuucuaguugaccuguugacuguuaacuuuuagugauucagcauuuaugucagaauuuuuaagauauuuguuauaugaucaauauugugauuaauuuuauccccauuauuuguuguccucagcaaauaauaucuuggauuaacuucuuccuaucauuguuuuuguuucauaccuuccacugucauuguaguuaugguaauauaacucacuuuggcauaugugcaguuuuuuaaaguagccauggugcuuuaaagcaaaauagaaaugagaaaaaucaagagaagcuuuugguaaaaaugcaguauaauuuuuaauuuuuuuauuugaaugggcucaggaaguuaaccuguuaugcacugcuacuagaauaucuuggguaugcaugcauuuuuaaaaaucuggcuuauuuugcuuauuauagguucauuacuuauuuggugggaauccaggaaaaucuugcucuccaaagaugagauuagaugacuucuggucacugaaguuguguagaccuucaaaagauuauuuacugaggcauugcaaguaccucauaagaaaacacagguaugaaaauaauucacugaaaacauuuaauuaacauuaucagcuauauuucucuuggcaaauuuaauaaugagacaguguaaauacuaugaagaucaugaauuuuguaaaugcccuguuauuccacuuauuuuugcuuucguuuuucaaaagaagauacaaaauacagauauugaugcuaaaaauuuauaaauacagaacaagugaaauuuugcagcuguuaaaaaaauggaaaauaauuucugugaaggugacaugccuacauugaaguaacuaaaagcuaacuacaaauuagaucaguucuaacuuaaugacacgugccugagcuuuugauaacucucuuaacugugaauguagugauauaguugacuauaccauaucuuccuaauuugaugugucacaauacaauuucaaagcuuguaguuuuaugucaccuuuauuauuaaauugcaaaaucauuuaaucaaacauuuucauauauauacauauacacacacacacacacacacgcgcgcgcgcgcacacacgcacgcaggcacccugagucauguuugauuuuuagccuagaagguaauaaacuacuaaaaaaugcagaaaaggauuucucuccuuuugguuacuguaguguuauaugguaauaaaaauuugcuuuagggccaggugcaguggcucaugcuuauaaucccagcacuuugggaggcagaaguaagaggauugccugaggccaggauuucaagaccagacugucaauuacuuuaugcuagacccuguauauuauucugugacagagccaggauuugagccugagcguucugacuccagaguucaccgcuuaacccucauauauacauacguaucaaugaagaaaaugaacaaaaaucugcccucaaguguccguucuuaagaagggagacuaacaauaaacauaauaaggaauuuauauuacauguuagaugguaaguacaaugaaaagaaacagauugaguuauuguuuguacaggugaggggggugggaauauaguuuuaaaugagaauaucaggauagacugcacagugaagauggcauuugaauagaaacuuaagggacaaaagggacugaaucauauagcugucuggugggguggggaguguucuagauagguaauagucaaggcucugaaguuaaaaagaugccugaauaauuugagaagugaauugagaagaagugugguggaaguagaaugagugaguugauugugguaggaaaugagguugaaaggacuaggaaagggacagcuuguaaagggccgucagcuuuuacucuuaggggagauugaaagauuuuaaguagaggaguaacacauucaggcuuguauuuuauaaaaaucauucugcauguucuucccgaagaacuggguaaaacucguggcugcuuucccucagguggggaauucuucagaaacaacggguuuauguguuggaaaagauuaguucaauuuggggcacuuuagguuugagaagucugugagagaugcaggcggagaccaucugaacauuuggugaaaagacuuggccugacauuacaguugugagucaugggagaaggagcuugcucagggugagcaagaagagugaaggguugcuggguauucucugaggaccaccaccauuugagggacaggcagaggaagagacacuccacaagagaucaagaaggcaucuuaacauuccggauaaacuuugaagauugugccaacagaauuucuugauggauuugauauggguaugagagaaagaaagcagucgaggaugacucuuagggcaucuugaaaaucuugucaacuacuaauucagacaauaaaaggcuuauuuuagaccuuuuucucuaccaagcuguuagauaaauucaagaauuugagggacaucgcuacauuauagacagaauagaagaaguuugugucuaugaauuggguagaacacagaaauugccuuuuuaauucaaauguuaagcagauuuauuuuuuuauaauacgggagcuuguacuacacuguuagacuggcuuauuuuuguuuuguucguaauggaaaauaaauauucuguuuaguuagaauauaaauuuagaaggagggaaagaaguauauugugugccaaguagguaccuccuuguuucuuacugaugucacuugauauaauaaauaaaauaccacuauuauuuuuucauacgacauucagguuuccaaacuugaugauuugaggguagaaaugggcaaaaaaaauuguuauaggauuaauuucuguuaauuuaggaacagggcagaacuguugauuaaaauacgauucuaggcugcagacacaagucugugauaaguucuugcuggccaaaaauagcuuagaaaaugaagauggagaacauaacuuucaggacacugaucucuuuacuggauauaggacuguggguguguguugguuagguuauuucagguuguaaaggauaauaacaugcuuuggauaccucagcugaaaaagaauuuauuauuagauuauucagggaauuaaggcaccuucucagcauuugaacggugaaacuggauggagaauuguuuaggauacuggaacaauucuaguagccaggugcuacuguagcuuuuccuuguaccucugucugcuucuuucuccaucugcuuguccuguccuacugacuacugcugacuuucucccaaccuuguggccuagauagauagauagauugauuagauagaugcauagauagauagguagauagauagauagaggcauagaaagauagauggauggauggauggauggauggccggccggccagacggacggacggacagacagaaucugccaucucauggcuucuguuuacugccuucucuauuucugucugcucuuuacauguccuuaugugucucacauucagauuaucaaagagaaagaaucuucuuagaaagcauuuccuggggagagugucccuauuaggaagaauucugccaaacuacuuuauaaacugcuaaucaaagcgugggugccaaaaccuuggucuaaucuaaucuguuguggacaagaugguaaaguaacauggucuuuaccuaaaggacucucaucugaaggcuguaagccuggcugucacucuuaggguacugccugguacaagagagcuguaauauuuugcuagucuuugucccugcgugaaguacagaaacccugucaccaaggaugccaucaaccugaacaccaucgugaaaggcucuucaucaucuuuccuacucaaagaaaauucaucuuuuccuugucuguauauuuugaaaaguauaccaacguauuagaaauaaaccuguauguaauuaugguauaacagagacguuaucuuuuucaaauagauauauagauauagauacuuauagauuuuuguuguuguuuaggagaacucauccagauucauucucugcaccucaguuuugcuuuuuuuuuuuugagacaggaucucguucugucauccaggcuggagugcagugguacaaucauggcucacuacacccuugaccucccaggcucaagcaguccucccaccuuagacucucgaguagcugggacuguaggcaugugccaccgcaccuggcuaauuuuuguagagaugggguuuugccauguuggccaagcugguuucaaacuccuggacucaagcaguccacccaccuugacuucccaaaguguugggauuacaggcaugagccacagcacccuguuuuuuuguuuuuuuugugugauaaacgaugauaaaauagaucaucaucauugcauuauugugagaauagaugaagugauacauguaaaauacuugauacaaugucuagcauauuacaaaugcuugauaagugguugcugcaguuguuuuuacugacugagacauggacauaaucucauuaaaaguaaucaguguuaaugauauucauuuaaaaauacccugcuuauuucaguuuccaagguaucuguuaagcaucuccauuagaaaauacacaaaucuaagcaaguguuuuuauuuuuaugucuacuuguuuuggaugaaacacauugggauuuucugaaguucuguuuuauaaaauacguaguauauucacuuuguuugguaguugguuuagugcuaccuuguaguuuuaagagaagauaggaaaugcuccuacccagucucuagcaccacagcugccugugaccaccuggcauuaccauuacauuuccaagaacuccacaacuacacuaucuaccuggcaguauuguuaauucuggauuccuaaacugacauuuucuaaauauccagaacaacuccucauacucaguauaacaguguauuuuauuccaggucugaaagacauuucugauauuuucucauaacuccagauaauuauccuuguguacauuuucuagguuugaagaaaaggcccaaguggauccccuuagugcucugaaauauuuacaaaaugaucuuuauauaacuguggaucauucagacccagaagagacaaaagagguaaagaaaggugguaauaaauuucagaaauuaaguauuuuuaaaugucuuccuaacuuauauuuaaugauuuugcucuugaguguguaaaggaaaacgaagaaaauaugaugacaucaguaaucuuuaaaaugucacagagcaggugaaauaaaaauugaauaggcauguuuucgugugauaagauucaagucaccaaaaacccuugguccauucagaaaaggauuaucagguauaaaguuuuaacuuaguuuuguguuuuggaaagcaaauagaaauuuuuacuuuguccauagucccaugauuauuuuacuuaaggauuacauaaugguucaauauaaacuuuucuguggauaguuaagaucccccaagagaggaaagaaaacuccccuguugcuuagggagaaaaugaagagagguuggugggaguuagaauccuuggugccuuaauauuuaguuaugugaauguuguagcaguauuguuugucuauaggcuacuaauuucauucaucacuaguugcuaagauugagaaaucaguuagccaaucauuacuuuucaguuuuuuguuacauaacauugggauagaaacaacuguuucugaagauuucauauccuuaaggacauguuugcuuauccauggugugugaaaaugccugcaaugauuuuuguguuuuugucauuuuuuccuuuuccaggcauccuuguucaucuagcaauaucugaacugcagugcauuugccuuccacucacagaauucgugcugauuauauguaguucugacccuuaggucucuuuccguguuagcuccugccuugcuuuggcuuuguaauagcaguaucaagcugugcccggcaugcuugagcauugacacaggugucagauuuaauguugaaucacuuucaggcuccagguucauuguacuuucaagcaauagaggcugcaugucuucagcaccauaacaaagagauacucuuucauaguuucguacuauaaaauuaaguccuaagucucucaauauugauuauggcccuucaguagguagagaaucugcaggacaugcuuuagaacccccaugaagggggacaguuaauugucuuuccuugaguuuucagucaauucaugacacugugcaaauaggagaaauaauuauaguuuugccaaguggcagaauauguuugauuuaaucuuuuaugacuuauaacuguacuuaguugugaagaguccauuaauguuaauuuuguuaugccaugcauuugagaguuaugcauagauuuccuuguauuuucuccauauucuauguaaaauagcuguaacugggaacaaucauuuuuuccuuauuuuugaagccaaaacaaaauauuucaaaguaaauaauuucagcugugugagcugcaaguaggccaaagaaaacaagacaguuuguucuuaaaguuaaacuaauggggaaaaaaaacaggacagggagguaucucaaguucauuugagccauuuuuaaaauuuugguagcugguuucuguuuuucuucuuuuuaaaauaguaacaacuuaggauuuugugugccaccagcuuccauuccauuucauaaaagcuuaaucuagcaagaauuggugagcccuaguagaaguuagaaagaaauguugaaguguguauguguguguguguguguguguguguguguguuggcaucagaaucaccuuggacacuuuuuaaaacaaugcccuuggcugggcgcgguggcucacgccuguaaucccagcacuuugggaggccgaggcgggcggaucacgaggucaggagaucgagaccauccuggcuaaugcgaugaaaccccgucucuacuaaaaauacaaaaaaauuagccaggcuugguagugggcuccuguagucccagcuacuggggaggcugagguagaauugcaugaacccgggaugcggagcuugcagugagcugagaucgugccacugcacugcagccugggcgacagagcaagauuccaucucaaaaaaaaaaaaaaaaaagaaaaaaaaacaccaugcccucacccuaagguucuccucugucugcucuuaaagaacagaaaauagaaaacauuccugacauugagaauuacugguccauaguauuaauauuuuguuuuaaaauuugugaacauauuuaacuuuuaaaauguuuuauauccaacagucuguuuggggggaagaaauccucugguaacaguucacauguauacucacgauauuugucagugagacauguagaucucauuguaggaaaucauuccacucauugagaaggggcuuacuguucuucauuuucuauaguaacuuguuuuuguucuguuuauauguuuuacagacauuuaauguuauuaaaugacuuucucauuuaagucucaaaacacaaaaaguguuuuuuagauuuuuuuuuucacaguuguuaugaucaucaucauugugccuguugucaggacauugacagcugacuaucaacuauauaacaaaaaaauguuauuggcuuccuccagucuucagaacauggguucugaauuggugaugaacuuacaauaaaucuuauaaaaaaugauauuuuuuucuagaaaagccaugagaaaaggaugccuaaucaauuauaccacuuucagagaagacuucuauaauagagaaggaaugagaauaaguuuucagcuacaauaacacauuuuauauucauuacacuucugcggaguuuccagagugcuggugucauucauuuaacaguuguguaucgauuccccauaauaggucaggcauucuaggcagaggagcuguaucagcaaacccaacaagaucccugcccaggagguacuuacauuuuaguggagaaagacaauaaacauuaaagaagcaaauuauauaguacauuagaauugaauaaguacugggccgggcacagugguucacgccuguaauccccgcacuucaggaggcugagguggguggaucaccugaggucaggaguucaagaccagccuggccaacaugguaaaacuccgucucuacuaaaaauacaaaaaauuggccgggcauggugggaggcgccuguaaucccagcugaucgggagguugaggcaggagaaucucuugaacccgggagguggagguugcagugagcugagauugugccacagcacuccagccugggcaacaaggaguuacuguagcucagcccaaaguaauaguagagcagugagaaguaaaauagagcagauucuuaauauauuuuaaagauagaaccaacagaauuuuaugauagauuagaucuaguguuugaaagaaacgacucaaagguuuuggccugaaaaacuggaaggauggaguuacuaucaacugaagugagaaaguucuguggggaacugguuuguggggacuccugacuggcauucaggaguuuaaauuuggaaauguucaguuugagauaucuaugagacagccaacuuaagauguugaggugacuguuggauauuugaauccagaguuugggaaagaggucuguaauaucccuugguauguguuaaaauccuuaggccaguacauacaguucacuuauuuaaucagauuguuaagauaauaguuuucuccuuauccuauauguagagccaauacaauuuauuuuucaccuuaggaguuagaaaagaggaacaaauucaaccccaaauaaguaggaaauaagaaauucaugaaauaggaaacaaacaauggagaaauuuuaaaagugaaaaguuggccuuuugaaaagguaaauaaauugauaaaccccaagcaagacuuaccaaguguauuagccuguucucacacuguuguaaagaacuaccugagacuggguaauuuaugaagaaaagagauuuaauugacucacaggcccacaggcuuaacaggaagcaugacugggaguccucaguaaacuuacagucauggcagaaggugaagggcaagcaagcaccuuuuucacaugauggcaggagagagagugacaaugaggggggaaaugccacacauguuuaaaccaucagaucucaugagaacucacuaucacaagaacagcaagggggaaauuggccccugugauccaauggucccccaccaaaccccucccccaauucaacaugagauuugggcaaggaugcaaauccaaacuauaucaccaagaaaaaaagugaaaacauaaauuauccacaucacaaaugaaaagagggcaucaguuuagacccuacauauauuaaaaguaaaguggguauggaaaacuucauugacaagccgcaacuugaugaaauugacaaauacuuuaaaagacacaguuuaccaaaacugacacaagaagaaauagaaaaucuuaaggaacuccauaucuacuacagagauugaauuuguaauaaaaaauuuucuaacaaaaaaaacucuaggcccauaauagcaguaaauuuuaucaaccauucaaagaaggaagaaaaaaauacaauuuuacauagacucucagaaauuagaggaaggcaauacuucuuaaauccuuuuauaagccagguuaacuuugauauaaaaucccaacagaagcugggcgugguggcucacgcuuguaaucacagcauuuugggaggcugagggguggaucgccugagcccaugaguuugagaccagcuugggcaacauagcaaaaaccugucucuacaaaaacaugcaaaaaauuagcuggguggugccaugccuguagucccagcuccucuggaggcugaggugggaggaucaccugaguucagagagguugaggcugcagugagcugugaucauaccacugcacgcugaaccuuggugacagagugggauccuaucucagaauaaauuagaauaaaauaaaaucccaagagagacguuacaagcaaagaaaaucauggaccaauauuuuucaugaacauaaauguaaaauucuuaggaaaauuuuaguuaauuaggaauauauuaaaagguuaguguacuaugacuaaguggugguuuauucuaggaauauauggcuaguuuaacauuugaaaaaaaauucaguguaauucaccauguuaacagaaugaaggaggaaaaccauagaucaucuuaguaagugaagaaaagcaucuaagaaaauucagacucauucauaauaaaaauucuuagcaaacuaggaauaaaaagaaacuucuugaaucuaaauuccuaaaggacaccugugaaaaacauacagcuagggcuauucuuaaacauuuaacccuuuucccuaagauugugacaaggaaauaauguauauuauuagccccucuauucaacauucuaccagaauuacacuagcuaguguaauaaagaaaaagcaauaaaaaacauauagauuggauaggagaaaguaaauuuguuugcauuuguagguaacaugauuauguacauucgaaaccccauggugucuacaaaacaauauacuaggacaagugaauuuagcaagauuacaaaaauacaaggucaauagaaaaaaaaagcaauuauuagcaauuuuuauacuagcagugaacaauuagaaaaugaaaagcauaguuuauauuagcaucagacauaucaaauggguagaaugagucuguuguaagaaauuaaagaagaccuugauaaauggagagauauauuuauggauugaaacacuaaaaauuguuuaaagcugcccauuuuccccaaauuggccuuuauuuuaaugcaguguaaguuuggucuuuguuguuguugucauugaggaaauagacaaacuacuauaaaauuuacauggaaaugcaaagguuuuagacuagccaaaacaauuuugaaaaaagaaaaaauuggaagcuuuaugcuaucugauuucaggacucuguauaaagccacaauaaucaagacagugugguacuggcuuaaggauagacaaauggaucaguacaacagaauagaguccagaaguagacccauacguauguggucaguuguuuuuugaccaggguaccaaguccaacggggaaaagaaaguuuuuaacaaaugauacugaauaacuggauaucucaaaccuuucucacuguuuacugaaacauuaauuuaagauugauuacaggucuaaauauaaaauccaaaagaauaaggcuuugggaagaaaacauaggagauuaucuucacaacauugggauagguaaagauuucuuggacaugaacuaaaggcaguaaucaucgaagaaaaauauggauaaauuggacuucaaaaaaguuaaaauuucugcucauuaaaggacuuuuaaaaacauagacauugccagguucaguggcucacaccaguaaucccagcauuuuaggaggccuaggaggaaggauugcuugauaccaggaguuugagaccagccugggcaacaugugagaccucgucucuaccaaaaaaaaaaaaaagucaaaaaaugaggcaggaggauugcuugaguccaagagguugaggcugcagugagccaugaucacgccacugcacucccaccuuggugacagagcgagacccugccucaaaaaauaaauaaauagacaagccacauacuaaacaaucuuugcaguagauauaucugacagaggacugauacccagaauguauaaagaacuucuauacauuuuuaaauuuuucuuuuuauccccccuuuucauaacucuugcuuagauaaauaccuauggaauauuuguacaauuucugaucuucaaaggaccauuaaucagggcuuacaaauguugguaugauuuaauaucugaaauguuaaaggcugcaagcauagaugugaaauauauccugaggacuuggugauacuaacugcucaagucuugggaagugccaaguaacuccauugaggaguuugucugcucuaauucauuccuuuaacuggucucuuuuccugcauucucauucaagauaaauacaaauaguucuccagauuuuuuauuuugugccuauuuguuaaauugcuaauguugcaauaguuuugucuuacucuguuucuucauuguucaauuacauugucuguuuuaaacuaacuuuaacugacagccuggaaaucuaagcaacauuuacaacauuauguccauuaaaaaaggucuuuggguuuuaacaauauaauuauauauaauuguggaaucucaaucuaaguuguaauuuaggaauggucuauacaugcuuuuuuucucagauuuugauuuacacagcugagacaucagguauuuuacaguggcuuacguuuauuuuugagaugagaaugcauauaugcuaaaaauucaguaacgggacccagggcaccaaucuguucauauguguuagauucaaaugacaguuuucuuuuuuauuuuguugugcuguuguuccuuaauaaguacauacuuuaauacauuuuuaaaauaaaauaauuccaggacauggcccaguauuuuagaaaaugauaauagccuaguagaaaagucauuauauucuguaaucugaauguguucuucuugccacuauuuggugaauagaccuaugucacacauaugcagaaauacguaguugcugauaaauggucaaaguuauagaaggcuauuuuccuucagugcacuuagccagcuaauuugcugcuucuuuuuuuuuuuuuuuuuuuuuaaacaguuucagcuccuggcaucagcucuauucaaaucugguucagauuuuacagcucuggguaaguauugcaguauaauuuauccagcuagaugcccuagcauuuggaagguuggauuuugguuucuuuuacgugaaacaucaggugagauguuucagucaaauagaugagcaaaugaaguuucaagguaucaugcaaaauuucuaauaaccugcuacaagguugcuuugagguaucauuuugcaguucaguuugcaaugacuauuauaccaauugcuguguuaguaugcaaacagauagcaauagaaacacagucaaaauaaauuaauuuguauagcacugccuuggaaugcaggcuguuuuacugauacacacuaugagauaauacuuguugauuaaauaguuuuuccucucaguucguucuuuguggaauugugugucgucaagagaauagcgaugggguaggcaauguuuugggagcacagaagauagauuaucucuuuccugaaaaugggaguuuuguuaucuuaauuguucaagauaacuucugguugaaacucaaguuuuucucaaacacuuuagucuuaauuuaguaauacucucuuuuaguauuaaugaauuauuaacuagacuguaggccgggcacaguggcucacaccuauaaucguagcacuuugggaugcugauguuugagcccaccaggaguuugagccaagccugggcaacauaguaagaccucgucucuacaaaaaaaaauuuuuaauuagccagguguaguggugugcgcccauaguccuagcuaccuaggagguugaagugggaggaucacuugagcccaggagguagaggcugcagucagccaagaucaugccacugcacuccagccugggugacagagagaaagacugucuuuaaaaauaaaaaauaggccgggcgugguggcucaugccuguaaucccagcacuuugggaggcugaggcaggaggaucacgaggucaggagaucgagaccauccuggcuaacacagugaaaccccaucucuacuaaaaauaccaaaaaauuagcagggugugguggcgggcgccuguagucccagcuacucaggaggcugaggcaggagaauggcgguaacccaggaggcagagcucgcagugagccgagauugcgccacugcacuccagccugggcgacagagugagacuccgucucaaaaaauaauaauaauaauaaauuuaaauaaauaaauaaauaaauaaaucagccgggcacgguggcucacgccuguaaucccaacuacucgggaggcugaggcagaauugcuugaacccaggagggggagguugcagugagccaagaucgugccauugcacuccagccugggcgacagaggaagacuccaucucaaaaaaaaaaaaaaaaaaaaauaccaagacuguaauaaaguggguggucucuagaacccagaccuuuacuugggugaauuuucaagggcauuuucaucaggauaacuuaugauagcuucauuuuuuaccaagauaaucgucuugaaguauggaaauucccagcuuuccucuggucagugaaugcauauuaaucccauugaugcuggugcaguuauuauuugccuuagaguugagcaauaguauugaaauuuuccauuguauguaauauaaauacuauuuuuuauguuuggaauaaaauaacacuuugggauaucaauuuaguuucuucauuauuugaccuuuuaucucuugaaagugaacuguaccucaaagaaaaaagaguauauauaauucuggugcuuuucacugggaugaaaaaauagagguguucuugaggucuugcccuuuauccauagcgagugauugaggcuucucgacugaucaaggcaacuccaguccuaaguucuaacuccagaauauguaggauuccucaggacuagacugagcagacugcuauaaacgugacuccagaagguucuccuaagaauuuagauaaugauuuaccacuauucauacacucgaguugaagaccuuaggcuacuagaaauccccagucugugagcuggagaaccuagguguaaacauuauuuuggaaaguucaugcccuucugaauucuagcauuugaaacagauguacugauacaugaauugggggucuggcauauauucuguuuaaaugauuaugugccuuaugucugauaccacagcccaggcccauuauuuuauuuauuagugcauagcacuaaacuaucucuaacugacuuauuuuuagccuuuagaacaagaauuucuuggcagcaauuuaaauauaucaauuaggguggugucagcaaauauuuuaccuucagcuuaacuccuuucuuuugacucugaccuauucacugccaacuaauauauuuugucaggaauaguuuguuuuauuuggauucuaaacaaaccucagauauacugagaacaauacaaacacaaaaagagaaaaauacaagcaggggaaauuccugugggauguuguuuccugucuugucugaggggagguauuauauagccuagugauuaggagguuggaaugugagauggugguugagagucaggaucucuuuuaaaagugaucuugagcaaguuauuuaaacuuucuaauuaucaguuucuuuaucuguaaaauggagguaaugggaauacuuaccucaaauugcugagagaauuaaaugaaauaauucugcaagauaguuaucacaguaaagcaguaaaugcuccauucaggguaccauuacuauugacugccuuaaaaauuuaaucuucuagccaggugcgauaacucaugcuuguaaucucaacacuuuuggaggccgaggugagaugaucaucuugagcccgagaguucaagauuaaccagaguaacauagcaggaucuugucucuauuuuuuuaaaaaagucaccuuuguaacacuggugaauuuggauaaggagcaaauucagauuguaugcuaauuuuaauaaugagaaauuugauuuaguauuuauaaacaagaaguacuuuucauaagguuucaugccuauuuagaguuccugguucuuguucuuauuaauuuucugucagacuguucuaucuuugugccaauuagaauagaaauaaaauggguuauuuacuguaccuuucauuguauaaaugaauauuucauuuucuaaggucugcaaaaaaaaaaaaaaaaaaaccucagccgaacuuucugaaugacuuccuccagaaauaauccaauuuauguucaucccuuagugagaauuaaauaaaaguauuaauauuguauguaaaauuuuaaagaaucagaaagauggaaggugacauuaucuuaguuuuggaaaaaugagugaucucggagaaaaucuccaaggaucuugauuuuagagcuucugguggcuauaggcacuuuuaagguugaacucagucacuuugcuaaguuuaagagcuauaucuuauuucuagaaaguaugaauuggagcaauuaaacuuauuuucagcaggguaugugacaaguaggaaaaaucuggucuguaaagcauguugccuauuuauuuauuuauucauucauucauucagacaggaucuugcucugauacuuaggcuggagugcaguggugcagucauggcucacugcagccuggacuuccugggcucaagcaauccuucugccucagccucccgaguagcugggacugcuggcaugcacaaccaugcugagcuaauuuuuuuuuccuuuuuuacauuuuuuguagagaugagaucucacuguauugcccagguuuguccuuuuuugguccucacaacucuuuuuagaaguuuacaguccaaauauaaaguuuaguguuagaaauaagaaguguacauuuaauaauguguaugcuaggaaaaaaaugagaauucauguuauuucuccuuuaccacaaguaggaaaauccagcuacguguaggauguuaaguuaaaaguauauuccuagccaggcaugguggugugagauggaagaaucucuugagcccaggaguuugaauccagccugggcaauguagcaagacuccaucucuaaaaacaaaaaauuacuccuaauaggucacuuucuuuuuagagcagucauugucaucagucauacuacuagugauaugcugauagcuaauuaauauuuauugagcacuuacuguggggccaagugcucuucuaagcacuuugcaugucuuaacgcaugauuauccccacaguagcccuaugaaguagcuacuguaugauccccuuuuguauaugaagaaacuagguuacagagaggcuaaacuaacuugcccaggcauagugcuagugaauggcaaaccaggauuaaaacccugucaguauggcuucagagcgccuuuucuaaaccacuaaauaugcuaccucucacugagcuuuaccaguuuccacugcucaaaugguuacuuccucuuuccauuuuacuuuauuuaugaaaauaaaguaagauaaacauagugauuaggagcaugagguuuagaaucaauaucaucaccuuuuuguccuagcagugccauuuaaguaguugugguacuguugaugaguuuccuagauccccaccccuuuuuaauuuauuuuuagaaaaaaacauugauuacauauaaagcuuagaauucuccuuaaacaacuuuccucaaucucuguauuuuacccucaaguauaaucacuuauacguaauacaucuuuacacacacacaaccauauacacagacauagaugcaguugguucucauuauucaaagaguacagaguuagguuccuacaagccucuggucacaacauuuuaucuacugauuaauauauaaccacguauuauguguguuucuguuuaaagauuccucauuuaauauauauuguugauucacuaacauuaaguucauggucaacaucacucuaacucauaccugaaccaagcuuaucuaaugugcauauuuuuccccauaaggccuuuuugcacuuaggaaugccagacagcacuuuggcacuacauuugggggccauuuuaaacagugaagccaccaaaaacacaaaaauguggcaccaaacagauggugaaagggcuguuguggauaguaagagcugaaacuagaaagcagcagagaucacagaguucagcuucagcuggggacgugugcauaugguaacucaaauauuuugccacuuugcacaugucugcaaugaccacagaaauaccacaaguauugguuuggggguuacacaugaauuuuagcaaacaggcaaauucacaaauauggaaucuguaaaugaucaagaucaacuguauauacgcaugcauacacucauauaaauauauagguuuguaugggcuguuuuaauuuauuauauaauguaaaaacauauucugcagcauaguuuuuuuaaguuaaugauguggcuuguagacguuuuuaugaagcuacacuagaucaguuguauucuuaugaagugauacauaauuauucauaauagggaucuaccauaauuuaaccauucgucuaaugauaguguaaguuucaauuuccucauagguaaauaguaaauaaaaauaaaagaugugccuuugagaguuaaaugagcuuaguacauugcccuacaacuuaagcacuuaaugagugugaguuaauaaaaauuaaagggcuuuggagucagacagacauggguuccacauuccaucucuucccucccuagcugugagacuucacugaauuacugaaucucuuucuguguaaaagagguagaugaagaacaaaaauaguaauaaccuuaagauuauugaaucucucuaagucaucucaucugaaacuggagauuauaauacuucauuguuugugugacaaugaaauguaaucauaccuaaaguaccuaccacacaggaacucaguguuuuuuccuucuuagauaauuugaucucaagaaaaugguguuacuuuauaaagaguagcauuacagaaucaauaucuucuuuuaaaaauauaacacagcauuguacuucuacauacucagaacguaagagaaagaacuaagccauuuuaguacagugcuuagacuguauacuuucagugagguauagucuacaaacaaaagcaaagaaauguugaguuugguugguagugguacauauauagcaaaucuagaacucuuauguauuuuaaguugagcaaaugaguacauaugauguugcugggagucaggguuuucuugguggaagaaaggagauauggaauggaauaagagaaggaagaauccucuggggcuuuaagaaauuagaauuaacaauaaaagcaugaacuauaauaguguaaaacaauguaugcauaugauaggcauauaugcauaggccuagaaacaaugacacccuggcaauuagcacagcuguucuuguuugguuuuuaaauaauagucacagcuaaaagaaaguaggacuccagagcuguguaaagaugaauuuggauauauaccagaaaguaaggaaguaccccaaaauuaauggguacauuucaaaaagacacagaagccagcucaaaaaggcucucacuggucaaaucuaggacaauaugaguaucagaaugaaugaugacaguaaugaguauaacauugagcaagagaagaaucccugaguacacagugaugcgaacaaauaaguaaaaugggaggaggggaagaaacagcucuucuuuacaauagaaugucaacaacuguagaaggagucauagagucagaaaaucaccaucauauaacugauaauuguuucagcaagaaucaucaaugauugcuaaauuauuggaugcagggcugugggagaacaggauauuuacacagucucaaacuaucucccuaucaauaguuuauuaauuacaaagguagaaaagaacaccuuuaccuuggagaaacuuggcauauaccaacuuaaguagaugaucaaaguuaacaucaucaguauugggauaaacugauaccacaugccuucugaggugaugcacugaggacacacaauaucacuucuguagcauucuugccaaaacugcauaaacugaaucugaucaugaagaaacaaucaggcaacccaaauucaacacauuccacucauaaguguucuguacucuucaaaaauauucauuaaagucaaagagaggcugaggaacuauuucaaacucaggagacuuggaaacuaaaugcagugugugaucuuggauuggauuuuagauuaguaggaaacaugacuguaaaaaagugacugaaaaauaacugguauuauugggacaucaauguuaaauuucaugaauuuaauauauauugguuauguaaguuaauguucuuguucugagcugaaauuaguuugagccuauagggggcaaagcugucuaaaacucccaaauaguucugcaaaaagauuuucagugggguacacacauggagagagacagagagagagagagagagagaacauauuugaugaaacauuaauugaugagaugaaucuaagugaaggcuauaugggguguucauugcacaauucuugaaacuuuucuguggguuugaaauuuuucaaaauaaaaaguugaaaaagaagcaauuuggaaauuucaaaaaaaaaaaaagcauaaaauaggaagacucuaaucucaccguucagagauaaccuuuguuaauauuuuggaguauuucuuuccauucauuuccaugauccgauagugggcuuuguuaaacucaagcucaucucaaguaaacauucucccucaaacuuaaaacaauauauuuuuaaaaaauaaaaaggaaugugcuguucuugagguauuguuuauuuuccuuccaggaaacugguauccuuggcaauguuauggucuauuccuguucuuuuacaagacuaaaacagguuggaccuaaaaugguacucuaaguugaaugaaaagcagucugaucugaagucacuuucacugaacaccauggcauauauaacucuugauggcucuguuucuguuucucauggcauuuagcagcgcucucaugucucagcuauuucagggauaggggaaauuauuuauuuuauuuuaucacuuaaauaucucauuuguauguaagaaaucugaagcagcugagauaaaccaauugaugaagacagcaucucacugaauauuccuuuagcuggaaugaacuugauaauugaauguuuauuagagguuaagggaaaaauccuuuagauuaacagucccuaccuuuuaaaaaugucauaugcuuucuaauguguaucaggauaaaaguaguucauugccuuauuccucacauaaugugugccuagcauagggccugguacauaguagcauaaagguauaguguuaugugcagauaccauucugcauauuguacauguaucucccucagucgucucuguuaccacucaguucccugagacuacuuccagcugucucagagacauuaaugauuuuagacuaauuucuaaagaccucuuucauuuugauuuuauuauauuuuuguuacuaaaaaacuuuuuuagugguucagaagcauuaacaagucagaaaagacaaguggaauuuccucaguggaccagcagagaaaagaccuaauaaggaaaaaaagagagaucaguauuauuuguaacuaaagugccaguccuucugcuagacgcuuuucauguaacuacauuuaaucugcacaauaacuguaugaaguaaacaggauuaucacauacuuacagcugaggaagcaaagucugaaagccagaaagucugacuaauuuaucuaagaucacaccacagccagguaguagaacuggggucagaucaguagugucugccugguuuugaagccugauuugauuucuccauuauaaaauacauugcugcuggucucaacuaguuuuucuguuacauguuuuaaacacaauggauguuucuuuguaucuucuucaccaggcuuuucugauguggaucacaccuaugcucaaagaacucagcucuuugacaccuuaguaaauuucuuuccugacagcaugacuccuccuaaaggcaaccugguagaccucaucacacuguaacugaagagucacuggacacagaaauggaaaacaggagucgauuuuccgucuuuuggauugcagcuccacugacugacaguaaagcugcagugauugaggacugcaccagaguucugaagggaucuuaaccaucacaaguuuuuacccucuuccuucaugccugaccucaaccccgcucuccucauccuauuccuaaauuaggcuaauaaagugaaauugguauacuuuccaguuaaauauauauauauauauauuuuuucuuacuuuaucuuuuaagaauuaaugaguauaaaagaaaaauuaggcaguuuacccuuuucagauuuuuauuucuuuuuuuuuuaauugggggaaauaagcacuauuaacagauucagcacuacaaguauuuugaauguuguugcuguuggucauuuggccugccuuuucccuuccuauuucacuuugccucccaucacacaacugcguguaaauggugucacuuguucaccucuuuacuucauucuuaacaaguguauaguucucuaggacaguugauguauguuaaggugauaucugugucuguauugacuugucuuguguuacauuaaacaguaggcagaacugaggucucaaguuugcacucuuggccauagaacuaaaaaugaaaccugagauugacccaagcaccuaucugagauugguauauaauauuucuauaaugauauauuuuauaguagauauuacaauagcaucugacuuugagucacagaaaccuuaaacugaggagacaauaguucagaaccuuuuuaagagccauucuaaaagugaccagcaggagggaucuaguagugaauaauaucuuaauagcaauuuuaggagaaaaugacucuuucguccagaagagcucugcagaaccagggcucccguuuaucuugugcuaucucuguaguauuuucauuugagagaggaggcugaguuuccagagcuuugcuuucauuuauuuuuauacacauugucucucuauaucugcuuguggauauuguuauuuugaagagaaaugguuugugguuguccagugguauacaacugacaggcauuucauuaagcacauagaccagacuuugugaaugguucagauauuuuuucauuaaaaaacaagguauggcagauggacuuuuccaugggucaaauuuuuugugugagagauagagguacaugucuucugaugaugugcuguggaaugcaaugugggaaaccuacaucuggcuagugcuuacauuugcucaaaaagcauguuguaugaagcugacugccaccaugcuaaagcagauucauauuaagaagugucggucgauccaguggcucuuaagagugaauagcuuuauggaaucaaguaugucccugaguagcaagauuaggccucaccaaagaagaaauuaaccugcacuuucaaaaaguaccauguauaggaaugaaacauugaggucccacuuuauucugucuuuaguacaugguuuuacuuauuuuggggauggauagaaauauauuuuugcuaguucuaggcuugaaucaugggcuccuuggcuuuccuagcaucccaaagcagucaacagugauuucuuaagcaauuugaucuguaccuuuacuugugaaagguaugcuauauaauucagcaaguaccaacuuguguagcugcagaauaaccaaguggcuauccagucaaguaaauacaguuugcuuacauacuucaacaguuucauaaaacgauuccccugagugacacaagaacauaaaauguuaauaucacuaauauagccuguuaaaucuuuuguggagacaggugcaaaucagaagauugacaaggaagaacuugagcuugcuaaauaagacuuccuaaauuuaaaagcucuaguuuugcuuagugugaauucuggcacuuuaaaaagauuaagcaagugaaauucugcugcccuccaccauuuauuuuuacagugcuuuguaauuuuuuucaucaguuccuuaaauguuauuuggaggaaacuaaguucuugaccucaguaauuuuauuuuuguuuuucccuaaauguuucccuacuagucuuuuuggaaaacauguuuguuuuaauuucaucuucccucacuuuauuuagguagaauuuuucccccuucauuucugaaauuuuuugcucaccgccauguuuaaaugggguugaaucauagcgagccauuugcucuugccaaagugagauagauguacugaggagauaauugaaaagucagacucuguacuguggggcuuuaaucggagcacugcuggaaaugauugcagagaauguagugcuucauauauccaugaccaagauugacauguugcucacaacaugucacaauuuagugaggagcuacauguauuuccaagaauuccagcauagauuauaauuuaaauaaucgaauuugguauuuagguacauuguuuauauagccaaguguauaugcuuuacuaccuaacaauuauucuagccuaggugaaucccuaauugaaacaccuggcuaacacuuuagacacauaaauuaagugggauacaguuuucucauuuguauuaucuccagcuucaaccucauuuauccuuuuuccuaguauaauacauuguuuucaaccagaaauuaaaguagauauccaacauuauuuucagugcuuguacuucaugagaaauaaucugauuuucaagacaccucuuaagugcauuugcauuuuauuuugguaauggcagagaccucauguggccaguuugauugauugaagaauguaucacucuuauucaagcaaaggaauucagacuuaaaugccuaccucugugcugaagcugacagacaguauuaacucuuaucaaggccaucuuuuagaccugauuuucauuuauaugaaaacagaccuguccaugucuaauaaguaaaaacugauagaauacauuaaaaagucacugguuuaucauagaaaaguuugauggguuuagagcucagugauuuaagcuuguaaaacugcauucuugggcaaaauauuuauauuguauauaaaugguuggcagcuuauuccaguugaucucuucacaucugccuuaaaagugcuauguagagauacauuaacagaguuauaauaaaacaguguuuuaaaaucuagccuauaaacaaaaacuaguuugaggcacccaagcauuuagugagagauugagaaugaugcuuaauggaucaaaaaagcaauuaggaguauguuccugauuuuauucucuaaauuauacucaauuucaugguaauuacaugaagaaguuaccugcaauuauucuuaacacuacauggaauucacuggguaauugugggucauuuauuuccugaaagucacgugaaauccuuagcugguugaauguugcacaguauuugagaauuacgguuugaagugauuucugugggagggaaucauugcaauguauauucuaaauaaagucaucuaacuauuaaaaaaaaaacacccuuccuaacccuucuuuucuuaaaauuccacauucauccacaaucucaucccuuuguagaaauucuugccugaauucucaccaaguuuugaauuccuaagguagccccgaucuaggaugugaaggcugcccagaaaaaguuuauggcuggaggaguaucauacagugucuacauaugauaguacuuacagauuaggucuuuggaugcuuuaacacaaaagauuuuuguuauccuuauuagucaaauaacgcuauucuuuugugguucuagacccuggcuucuaucucccugugauuuguuuuaaugcugaaaugacuuggcuauccaaagcuucuagucuagaggucuguugguugaaggcagacauuuccaaguuuguugaaauaauacgaagcugacuagcuuacgugaaugauguugcccucauuuguuuugggugaggacucauuacugcaguauauugaucucuucaccaaaugcuuuuucuuuuucugaauaaaugcuguauuagagguucuauuuauauaugauuuuuaaaacuuugguuuccuucuauccaccaaauacugugaauuguuuuuccauuuauuuuucuuagcuaauguaacuuuauucuucacuuuuuuuuagcccuagacuuccuagauuuucuguggcauucuguaggacauuguauugcuuggaaaaaaaaagaucaaaaucauucuggggcaaaugcucuauuauccuuauuuaugacaagagaauaaugaaauucauaagaaauuaauaacauucagauauugcuauaaauguacuugagucauuuucauuuggggauaguaauaauggcuguggcagcuuuaauggagaaaccuguguuggccucuuuuucuggcauuaggaucucuugucauagaacuauugguaaaguacagguuugauagcagaguuccugaauucagcauaucaucagaauuuccauuuaccuuuugucuuuucuuuuuauuguauuuuuuaaccuuuuuguuucuauuccuaccucccaugaguaacauugauuucugcugaaguuagaauuuguguuaagaauugacuuuaaacuucugaaauaguugaauauuagaaguggcuucaguugccaugaaaugauugcuuuucuuuuucuuuuuuuuuccuuaaauaaaaauaaugcagccuuauauaugucucuuccccucaagaaugugaauuuaggcugggcauagugacucacgccuguaaucccagaccuuugggaggcugacacgggaagauugcuugagcccaggaauuucagaccagccugggcaacacaggaagacuccaucucuacuuaaaauauuuuuguuuuuuagccagguguggugguaugugccuguagucccagcuacuugggaggcugaggugggaggaucacuugaacccaggaguuuggggugcagugagcuaugauugcgacacugcacuccagccugggcaacagagcaagacccugucucaaaaaaaaaaaaaaaaaaagaaugugaauuuagcuccaauuccaaaugacuaacucuuaggccagucauagccaaugaaaucaucugacgguagcuucuguagcccuuaaccuaaggagucauuagagguuauaguaaauuaguuucucuaguggugcagagagaaaugccaucggggaaauuaucacugucuuuuuggcuaaaguuuuauauugugaacuggaucccacuuaacagcuuaaaaacacaaaaaugaaaggguaguccuaguuuaucuucuuaauuagaaucauuauuuggaaauaagauuugcaaugugcugucuauccccaaacacugcugagcuugcuggaaaacagaauuuaacaugaauguugucugaaagcuguaggaucaauggcaaaaaaggggaaauguuugguagggaauuggaccaguucuaagguaucacuuuuaauuauaaaauaaugucuuccuuuuuaucugcuuuucagacagccucagugaacuauuaaacauuugugugcaaaguccuauuuugcuuaucuaaggcauuuugacuuggaaguauuaaacuucaggaacgagcuagagaagacaaugaggguauguuagagaaggaaaaauaggagcuuuuugcuuauggauuuuagagguccacaaaucgaaaggaaaaauaaauuucuucauuucuaacccuaaaauaauuuuguuaaugagaugcugggaagaagacuaccaaaaggccucaaagcucaugcuucuagaauauucaguaauucugaauagucuuugggaaguagcauuucuugggaaguagcauuucccuucuuccaaauaacuguuugagaucuuaaaacagaaaauccaguguuaaugggcucuagaucuuaaacuaggugagcagcuucuuacauacaaccaguuccuuguuaaggauccagcaggaaaaccagccauaaaacauuucaacaugcaguuugggggcucccuugcuuauucacugaguuuaagcucuugcugcaacauagcucuguaccaucugggaugcuagcagucacagcaguuagcucagauaucugagcugucugccacacaaagccugaggagaucaucauucuucaguuucauucauuacuuaaugaaugccaaauuaauuggcaggaagaagaaacacugugugauauacugaacaagccugugugcaugaauaaggagccacucaaaaagccaauuuugagcuuuauuucuccguuguuaacaaaucucaagaaagccuuuguuacaguuuagcucaugucauuugguugguuuuauuuucuagcccuuuaacauaggaggaaaauugucauuucauguauaacuuguaacacagaauugaacugauacuaguuuccuugccuuaaauuaauuauaugucaucccaagggucucuguuaauucugcuuugccaagcaauaaugagaucuggguuuggcauuagaaguauuucauaauuuugguuuuuuauuuagguuuccuccacaucuguaaagugauugauuaaauuagaggaggcguguagaauaaaucccaaucccauugcaacuggcagagcuuuauaaaucuuuauaaauucaguuacaacaaaggagaggauccuacaccauuagagccaugccaucagguguuugcaagugacagcuguaguguguugccucaaauaauaccaaguuauaaauaauaccaaguaauuaucaacucacucccaaauuuaauaagauaucaaaguccaaaagguuacuuaggaguagucuuccgugggggaagauaaauuuauuaaagagucauguacugaucuuuuucuugggauuuuuuuuccuuucccagaaaaaaaaauuauuuuggugacugaucaauuguaaacaauuuucuuccuuacuuacaaaucauccguucagaaaaauaaaaguggacuuccuuuccuaagcauuacaauuagccugggcaagagguguuaugauugucuuauucuuuaagccggcuuacuuuuuggauuugugugaaaugucuuuugaaaagaaaguagauaguauaguauuaauuaacuacuuuguauagucuucugcauaauuuagaguugaaaauaauguaacauuuuccugugaacagauuccuuuaugcguacauacuuuauaaauauacauacauacacauacacauacauuuuuaaaaugcucuuuuuaaagagauucuuaucuugcucccacuccaaaagcuauguacaguugaguuauuagccucagaggaagaguacaggaaagcgaagaugaggaccuccuuuucuuguguuggucuugggaacaaacaguauuccgucuuucaaauauggcauauuucuaaacaguuugggaaagauguuagaauuuuuuaaaagucagcucuuuuauaaauuggaaguacucaguagucagaaauuaagauccccucugauagagauagauucucaaaaccaaaauuggacugaaaauuagauugagaagaaagauacaacuuccuccauagccaauaaaaucugucuuuccaagucugcuuauuaaugcugugaaucgcuccuucuguuugugaaaacaucuccuggacuggaaauguggugcuguaaccagcugagccgaaaguuggagaauguuaaauaucuuauaugggacuuacgauaaaauguauugauguuagugauugucaaaauagguuuaucauuuaaaaaacuaggaaauuacuaaguauaaagaagaaaaaccaguauuaauuaagugaugagaccuguucauuuuguuuucccugacuuauuuccauuaccaaacauaguaaaggccagaaaagauuaaaaaaaaaauuaacacagccauuccauuguuuuuuaccacauggagaaaggaccaggcuggaagcauauguccccccacccuuauuuauauuccuuugagcauugccguuuucuagacagacaauccgaaaauaauuguguugauaggucuguuuaagccugaacucuggguguaaaauguuauccagaagcuauagggagcugccuugcucaggucauuggaaauuucaacccuaagacucauuggaauuucuaaguccguuaugcaccauuaugggcauauggagcauauucauaccaugaggaggagucuuuguuuaugauggacuuuuuaauauggccauaauuaaacucacacucaaaaaggaugagcuauugucaaaagccaaaagaaaaacagacaaaaugaacaugaagcaaggaguccauaaaacaagaguucuuuaccacguuuaagcaaaugucucucaaaaaaaauuguauuucugugcacauuagcugagauucacacauuuugcaccucaguaguauuucagaugagacucaauguguggagaaaaccgcuaacuuguuugguucuacucuuacccccucuucuguggcaauguggggucagggccguauccuaaaguauccacauggucuuaaauggaaaucaugggacucuggaaagcuggcaugagcugguuggagcuuuuaaacagaagugcuuuauggguaucagaucucuucugacaucaauuguuucaaaucauuguugggcucugucguguucugcaaucuuccccauuccccucaugaucucuggcuuaucuuuuauccaaucuguauggacuuuuuaggauuuuuuuuuucuuauaguacaaauaauuuucagaucccagcuuugguaaauguguuaauucuacuuugugaauaaauaaaugagugaucugcuaaaaauggcaauuguagaauuauguuguauguaauguacauauggagaaagaauguauuuuguucauuuucuuaauaaaauguuauauauggaugcuacaagaua

SEQ ID NO: 191595 - RNA, 125254 nt, Homo sapiens
gacagauacccuccuuccggccgcgccacucgggaggcggaucccgugggccugaggaggcuucccccgcccgguuugcuuucccucccucgcuggcgcugccgcgaguccaccgagcggccucugaggagcagccgcaggaggaggaggaggucgucgggggcggcgggcggagaccgcgcucucgcuuccccggcggcggcaagggcaggacaauggagguggcgguggagaaggcgguggcggcggcggcagcggccucggcugcggccuccggggggcccucggcggcgccgagcggggagaacgaggccgagagucggcagggcccggacucggagcgcggcggcgaggcggcccggcucaaccuguuggacacuugcgccgugugccaccagaacauccagagccgggcgcccaagcugcugcccugccugcacucuuucugccagcgcugccugcccgcgccccagcgcuaccucaugcugcccgcgcccaugcugggcucggccgagaccccgccacccgucccugcccccggcucgccggucagcggcucgucgccguucgccacccaaggugagaaccggccgcggccgcuggggagcccggggagagggccaggagggggcgggcgcccuugugcggcgcgacccgcugucaugucgccgccgcccggggugcgcggcgggggaggggcgagcaggagggucugugcuggcgacggugacauggagggcccgcgcucugcggcgugucgcgcucggccagcaacuuccccgggcgcuguggacuugaccgcgccgccgccgccgccgcugcuccgcauucucaacagccgggcggccccugccacucgcacuuuugcagaccucugucggagucuccugcagccggaaucucggguucuuugccggcugcagccaguuaacugcuacccgcccgcugccuccacaaagcuuuguccagguccauaugauccugaucaucucgucuauacucacguuauuugagcugcaggggagaagggagggaugaagaugaagugauggugacuuucuuugaugauugauugcagaucggaugucauuuauuucuuaucuugcauguuuggggcucuuuaccuuaaugaguucccaguucucuucccucuccucugcuggggacaaaggaaccaagagacguuguuuuguugugugucucuuucaaagguuuuauuuugagacggcgaagagaaauaauacaaagugauuuggguuuucugguauuuuauagauaaagcuggaaguuacuguucucuuugugguguuuauuacuguaaaauuagacuuuugacagguguuccauugcuaacuuugacagguuugaaacauuuaaaguaaguuugaguacaguuucggguagaacacuuggcgguuuuuaaauuuuauuauugcaaauauuugagcaccuccuuuuuaaaaauacaguguaacuggaaaagcauuuuuaauacuuuuuagaggaaauaguugauuuaguuugaaauaaaaugcuaauuaaguaauuaugcuaggucaaggggcguaugaaauggauacuucaaauagauugugggcugagacucauuuauuugacugcauguuaggagcaguauccacuuguaggagacaguuuuccgugggucuccguuucuucacucuugccagcacccuugccagcgagauacugacugcccuuuguuucuauuuuuucacggauauuaucuaaagagcagccuuggaagauagagauagugucuuccaccagagcaaaaggcggggauacauauuauccaguauaauaagaauaacgucucccucuggagcgaaaggguaggcaugcuuacugcccaucuuaaaagauuaggguucccuaagcuuaggguuccucuccuguagagaaggaacugccuguguagaugucaacuggcucucuuuacguuguccaaugggaaccuggaguucugagaacuagugcaaaaaucuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccaaaaaucuugaugaugcuuuggcuuaugcuguuccugugaguaaaaaacaaacugcccugugucucugacccuugaaugucuucugucaccauccaugaaacugguaagguuauuuguuagcuugcagguuggacacucucagauccuucgcaguaguuugcucugaagaggcccacgacuggaaaguucgaacaggugaaagcuuaaaccuuaguucuuauuuauuuauuuauuuauuuuuuuuuugagacggagucucgcucuucuugcccaggcuggagugcaguggugcgaucuuggcucaccgcaaccucugccuccuagguucaagcgauuguccugucucagccucccgaguagcugggauuacaggcaugcgccaccacguccggcuaauuuuguguuuuuuuuuuuuuuuuuuuuuuuuuugguagaggcgggguuacuccauguuggucaggcuggucuugaacucccgaccucaggugauccgcccaccuuggcuucccaaagugcugggauuacaagugugagccaccgcaccuggccuguucuuauuucuuagacacaguuuaagguugguuuuuccuuccuuccuuccuucuuuccugcguucuuaccuuccuaccuucuuaccuuccuaccucgcuuugucguucaggcuggagugcaguggcacaaucucagcucacugcaaccucugccucccugguucaagcgauucuugugccucagcugggcgccacaccuggcuaauuuguguuuuguuuuaguagagacggaguuuugccauguuggccaggcuggucucgaacuucugaccucaggugauccaccugccacagccucuguaggugcugggauuacaggugugagccaccccacccguccucuuccauuuauauuuuaaaugguuaaacaggcuuguagccaauuaagaucugaauugugcaugauuauagaauuaugacauauuguuugccuggccaugacauauggacuugaauuaaugagaacaugggucguaaaguuaucauccucaauucugagacaaguuugugauuccauacuucucaaaauguucuguguaauuacaaucugaauauuuuuuaucuuuaugcuguauuguacgcaagaguucaaagaaagcguuuaaauuggaagauguuuuuguuuuuauacuaggaaaaacguuuuaacaaauuguacuuaaaaguacaccuaaaaagaauuaaaguuaucuuuaaaaaauuaaaaaugcuauccugagucuuagugacuuggguauuuugucccuuuaucucuccuugcauacuuauuuuaauacuagcugaagcaaaaauuuagacuuuuuuuuuuuuuuuuuuuuuuugagacggagucucgcucugucgcccgggcuggagugcaguggugcgaucucggcucacugcuagcucugccucccggguucaggccauucuccugccucagccuccugaguagcugggacuacaggaacaugccaccacgcccggcuaauuuuuuuauauuuuuuaguagagacgggguuucaccguguuagccaggauggucucgaucuccugaccuugugauccgccugccuuggcccccagaagugcugggauuacaggugugagccaccgcagccagccaaauuuagacauugcuuaacuaaauaacggguucauuugaucaaaccaguucuucauuuuccuacugaauuugugaguacaggcaucacaagucaaguaauaucuauuacacaaagguuaaauagguaguugggauggagaacugugugagccuugggguaaaaugguaggaaaugauggggaguacaagcaggggggcagacucuucuuagcuauagcaauuugucaugugagugcagggcaaguauugaaggaucuuuuauuuauuuaaugcaaauucugaaucuggauuuuugaacaaaauuuuucuaguauuagauauugucaacuaauuaaaaaugugugaauauuuauacacauaaauauauauacacacacacaauuaauuuaugggcccaugcuauaggccaaacaauagguuuguugaggccaaauauguuauauuucauacacuuuuuagauuucaaaaacuggagauuuucaaacuuuaacaccacuaaacuuuaacaccuaaaaaaaauuuagauuuuuaggccccucccuccugaaaaucugauucuaccuaaucuggcguaguugcagaaugcuaggguauaauacaguuacacucuagaauuguuucuuuaaugcaagcaguauucuaaaacuguuucagaucuaguuucccuuucuauaaaauacuuuucaugcucucuuugucauccuaaaugaauuucauggggaaaaaaaauccuaacacauuuuucuuacaaaaguaaacauaauguuugaacuguuuuaaaggagaaauaaaaugaagcaaauaacagcagaaaaguauaauuuauaaaugcucagauacaauuacacuggccaccaagcucccauugagaacauuuguuuuaaaacuucgguuuaacuguccuuuuuucucaggcuacauguuggaaggaaugagggugaaugaccacaaguuaaaauuggaugacuccuucagucuugacugucauuuucuuaguaugcaguuauaucuaggagagaggcaaaacuuuaggaaauggauuuucuuuuacguauguuaagaaaacaaacugaucuuagagaaauguuauaauauuguguaguauuuuguguuguuaacguacuguucagcuaaugaguagcaaacugggaguuugagagcaguuuuuuccucucuaccuaaaagacaauauugaagagcuauuuuuaacaaauacugagaacauacuuuugaaagguauuauuugucuagagaggguuaaaauauaagacuaaaucccuuuuccaagauuucuuuacuaacuggcaguauacaagauacguaacuauucugggacugauuucuuggcaaaaaguauaaaucaucucaugagugcaaucuuuaauggcaaaggauuaauauuuaagaaugaucuguguuaccugucaguccuauauauauaaaaauauacauauuuuuauucaccuguuaguagguaucaguauuuuuuaguuuggagcuauuaugaauaaaacuuaaagguauuuguagaaaagucuugguguggauacauugucauuucccugaggaaauaacuuagaauuggaauuucuuguuuuuaugauaaauguauguuuacacugcuuguacuacuuuauagacccuccagcaguucucuccaaaguuuguucacacucuccccaguuuuggguauugucuuuaaaaguuuuuuuuguuuuuguuuuugagacggagucucacucugucgcccaggcuggagugcaguggugccaucuuggcucacugcaaccuccaccuccaggguucaggcgauucuccugccucagccucccaagcagcugggauuacacuacaccuggcuaauuuuuuuguauuuuuaguagagacaggguuucaccauguuggccaggcuggucuugaacucuugaccucaggugauccacccgccucggccucccgaagugcugggauuacaggcgugagccacugugccuggccugucagucuguuaaauuuuaaccauucuaguaggugagaaaagcuaucucaugguuuugguuuucauuucucugaugaauaaugaugagcaucuuuucuugugcuuaguagucauucuuuuuuggugagauuuugguuugucuuuugcaaauuucaaaacuuaaguugcuuuuuuuuuuuuuuuuuuggagacagcaucucacuguguugcccauacuggagugcaguggcgccaucucagcccacugcaaccuccgccauguugcucaggcuggucucucaacuccugagcucaagugaucacccaucucgucucccaaagugcugggauuaugggcgugagccaccacgccuggcugggaguuugccuuuuuauugaaacguaaaguucuuuauauauauucuauaucuagguccuuugucagauacauguauugcagguauugacucuggcuugcaugcucauuuucuuggugucuuuugaagagcuaaagguuuaaauuuugauuaagucugguuuaucaauuuauuuuaugguuaaugacuuuuguguccuaucuaacaauuuuuugccuaccccaaguuuacuaagauuuucuccacuuuuuaacccagcauuuuuauaguuuuagcuuuaaaauauaaaccuguaauccauuuugugaguuauuuuuugugugagguugagguucauuuuuuuaaaaacuguauguuaaaacaccauuuauuaaagacaguacuuuuucauuauauuauuuuggcauuuuuauacaaaaaucagccaucuguguguggucuguucuuuauugauuuguccauucagcuaauacauaauguuuuuugauuacaguacucuucucagcaaauuuugaaauuugacaguuuguucuuuuucaaaauucuuaugauucuuugaagucauuugcauuucuuuacauuuuagaaucagcuuuucaguuucuacacaaaagucugucaugguuuugauuggaauuacauugaaucuagauaucaauuuggguaagggggaauguguuuuguuuuguuuuguuuuguuuuguuuuuuugagaugagucuugcucuguuaccaggcuggagugcaguaaugugaucucugcucacugcaaccuccgccucccagguucaagugauucuccugccucagccuccugaguagcugggacuauaggcaugcgccacuacgcccagcugauuuuuguauuuuuuaguagagacgggguuucaccauguuggccaggauggucucgaucucuugaccuggugaucugcccgccucggccucccaaagugcugauauugacaggcgugagccacugcacccagccauaauguucuuaacaauauugguucuuccaaucugugaauauguguuaucucuuaaauucucggcacugucuugugguuuucauuguagcauucuuguacaauuuuuguuuacauaguauaaauauuaaacauuuuauaauguuaaaugauaucguauaugauauuuuuaaaauuuucauuucaaacuguugguaguauauugaaauacgauuauugguuucaucccauuaucuugcuaaauucgauuauuaaguaucuuuuuuuuuuguuucaaggacuccuuaggauuuucuauguagucuacagggagauagcuuuacuucuugcuuucuauucuuaauaauuuaugucuucuuauugcaccagcaaggacuccaauacaauauugacuagaaguugaauuucaguauuaaaugagaaaggauuuccuuaccuuauuccucaucuuaggaggaaaacacucaauuuuucaccauuaauauguuagcuguuuucuauagaugcccauuaucaaaaugaagaaguucccuucuauuuuuaauaugcugagaauuuuuauuaugaaugggugaugaauuuugccauguacuuuuccugugucuauugaaauggucaugcaauuugucuccuuuuuuuguuaauguaugaauuacguugauuuuuagauguuaaaucaaucuugcauucuugagauauaccucacuugguuuugcuacagguauuuugaagcuuuuaugaauugccugcccuuuuuuaaggugaaauguucuuugcuuccuauaaugcuauguuauggucuacuuugccugauauuaaugccauuguuuuuuuaaucuauguguuugaaugguauauuuuucccaugcuuuuacuucuagcuuuuuaaaguaucucguagauagcguauaguugucuuacuuuuuuaucccagcuuuuaauuuuugcuuuuguuuaauccauuuauauuuuauguaauuguugguauggcaagguuuaagacugacaucuuuuuauuuguuuucucuuuguuccugcuuggccuccaguaucuuugcuucucucucaaucccuuagcagcugcucucugguaaacuucccauggacuugcucugcacaugcguaguagccuucagccaaggacuuggcaaaacccuuacauagacuacuggcacccuuucucuguucagcucccuucucccaagugcuuugcccuauauauuccaucugguucacaauccccgaaucucucuggcuccuuugcuauguucugcauuggcuguagcuccaugaaccaugaucacaaaauaguccucaguuagggaaucaagauuuagggggcuuauucaccugagcuuuucuuuccucauggaucacaguacugcauugccuuuuguccauugucugaaaaguugccuaagguaucuguccugguaauauacaguaauuaaugacaggaaagcuugucucaguacuaguuacucuauuccugguggaaaacugaugucagaagaaugcuuuuuaauuucauuguaccuuuuuaaauauacccaaauguggguaauuuguaaacuuucauuuuuaggucucuagauuucucuguuuaauuuuucuucaagaaguuaaacuaucaacuagaugcacaaguuuuucaaauuucuuucugcaauguaaccuugaccccuuucucaauuuuuuuuuuuuuuuuugagacagugucucgugcaguggccaucuuggcucacugcaaccuccaccuccccgguucaaacaauucuccugcgucagccucccaaguagcugagauuacaggcacacaccaccacaccuugcuaauuuuuuuguauuuuuaguacagacgggauuuuacccuguuggccuugaacugcugaccucagguaauccaccugccucagccucccaaagugcugggauuacaggugugagcugccgagcccuuucuuaauuuuacuccagcauuuugaauacacacuuagaccaguagucuccaaaauggcaugacuaagugccauuauauuuuauucuguaaugugguguggcacaccacauaugcaauaaaauauccauucaggugagggaagacauuagaacuucuuuucagaaauugagcuuuaaaguacuugauauauaguuugucacagucacaugaauaagcaugucaaauggcuacauuucacauaugcuguauggaguauccugagagaagggauuaaggcugccucaagcccaaaugguauuugugugaguuagaaauuaagaguccucuugacauacaggaccaaaggaugugugccuuaggaaguggaauguggacccccauuugccuguaagucuacauuuccccuccagucaggcaguuccuuguacuguauaaccuaucuuaacuguacacagcugcccuagaggucaugggauuucgauacugcagacucuguuguuuguuuuugccuccuacaaguauaauuuuuuuuuuuuuuuuuuuuuuuuuugagauggagucucucucugucaccaggcuggagugcaguggugugaucuuggcucacugcaaccucugccuccuggguucaggcgauccuccugccucagccucccaaguagcugggagcauaggcgugugccaccacacccagcuaguuuuuguguuuuuaguagagacaggguuucacuauguuggucaggauggucucaaucucuugaucugcccaccucggccucccaaagugcugggauuacagaugcgagccaucgcgcccagucuuuguaacauaauuuuauauguacuuguaaaaauagguuuauggguuuuaauaucuguuuuuaacuaaaugucugucaaaaaauagaagauuaugguaggccauuaccaggccucuggcauaaaacccuuaaucucauuuccuagggaagucccauauggaggcugcucacaaaagccccuuaauuucagcaguuugggaagucccuaaguuguaggauauaggguacauguauaauaaccuuaaaaagugaucgcuuguuucaauuaacgacagagacaguuccauuuaagucuguaacuucaccaguguuguauagauggauguauaccugucauucuugggaccugaauaugcaauuagcugacaaggggauuagcuggcaaggagaucccuguccuauagaaagcuguagcuguuacugucucaauuuuguguuucauguuaucaguguguggaguugauggagcuuuaauuuuucaccagcuuuaaauuauuugaaucuuagaagucuuauuuucaguuaugauaaagauaguacuccuuugcagguagaauaacauuaaaguggcagagcuggcacuuuauaggcucuuaucaguuuuauugugagguuaacaacugauuaucuaaccagaucuaacaagaagugggccuaaaaguucaaaauuaacaagauuacucuuugaaauugacugacauccuccauuacaaaugauggaccaugcauuaaguguauacugcaucugaaagcauuaguugacaauagugugaagcuaucuugauuagcaaaacauuuaaaaauauuuauuucaucuugauuuuauuccuuauauguuuuacgcuaauaugauuuauuauguauaggauguacuagcacuguaguauauguacaguacauguucaaauauuugugucuaaaauaaacauaacuauuaucugaauugccucaauauuuuugcuuuucaucuagucuuucaaaaccuuuuucaaaugccauauccucuuugacauuaugaaaccaccuuauuucucaaaggacuuucuucugauuuuuuuucuaauauaaauaaucuauagguucucaucucauaguauaauaaauuuauuuuuauuuuauuuauuuauuuauuuauuuugagacagagucucacucugucauccaggcuggagugcaguggugcaaucuuggcucacugcaaccucugucuccuggguucaagugauucucaugccucagccuccccaacagcugggauuacaggugcgcgccaccacaguuggcuaauuuuuguauuuuuaguagagaugggguuucgccauguuggccaggcugguuucaaacuccucaccucaggugauccgccugccucagccucucaaagugcugggauuacaggcaugagccaccgcacccggccugguauaauacauuuaaaagaaaaaugucuucuauaggaauuaggaauccugacuaccagaagaucuuuauuuuauuuugauuauaggugaagagucucccuuauaucucuuaccaaaggcagcaguguuuuacagggucaugcuccuccugcaaggucaaguaagagaagacuaaaaaaagaaaaaaaaccaaccauggaaaagcauauagguggagagauagauagugaaagccagauugggguagguuaaacaaugagagggagaugaaaagacauaguuggaaaguuuagacaacucugaaguggggaggaaugggauaagguaauacuuaaggggagaaaaaaaauaaaaaguugaggaagguuucucacuuucuuuuuauauaaaucaggcuuaaaaacauuuaaauggacauggaaaggauccacgagaacuacugaauuuauaaaaaaaaaaaaagauuuggugaggcuucugagaaagcagaaaggcauugaucugaggcauggguagagauuggugacuuuggauaggagacacacuuucucuugugaauaggagagaagguaagaauaggugcuaaauacagguguguguguccucaaaauggguggaauuucuguauucugagccccccacugauuucucccuuaaauagaaagugaggucgucugcugagaaugagaggguaacaggaguggaacaagguugagaagggaguuuugaaguugaccaauaaaauguaguguuagugcagguuguguugaggcuuguuuggugcuaaagaccaugaauuaacaacgauaccuaucugucuucuuauagugcuaucuagugccuuuuugaagcaggguauuuuagggcagugcuacucaaggcaugagcugcgaacuauuagggucugaaacaagauaaggacauugccacagaauguugaccaguguacugcuuccuucauccagcugaacuaaaugucagcugaacuaaaugaucuugguugguuuacauucugacacaagcucuuaaaaaaauuuuuuuuuuaaauagaaacagggucucacuuuguuagucagguugaacuccuggacucaagcaguucuccugccuuggccucccauucaaucccuuacgaugguuaauaauuccuuauguuggcugggugcguuggcucaugccuguaaucccaacacuuugggaggcugaggcaggcggguuaccugaggucaggaguucgagaccagucuggccaacauggugaaacccugucucuacuaaaauuacaaaaauuaaccaggcgugguggcaugugccuguaguuccagcuacucgggaggcugaggcaggagaauugcuugaacccaggaggcggaggcugcaguuagccuagaucaugccacugcacuccagccugggugacagaacgagacucugucucaaaaaaaugauaauaauaauuccuuaaguuaaacuucauuucaaauuaaugugugguuucucucuacuuacuguaugcagacugaugcaucauuuugggcaacagugauuugucuuuuucaaugccuuacauuaagaaacacaugauugucuuucugucccguuguuaguguuggccuugaucacuuguuuaagguggugacugccagauuucuccacucuaaagcuaucuccuccucuccuuuuguaauuaacaaauaaccuuuuaggagauacuuuggagucugugugaauauucuguuccaaaaaaacuuagauuggcauccacugauuucuugccuuuaucagcuauuacugugauaguacaaaaugguuuuucuaucacuguaugcuuacuaguugauagucugcuguauggauaaccauuuucuuuuccauuuaucuaucauggacuuaugaaauauuuuagucaguauguuauagccauuccuuucuuuacuucuuuugacaaucaaauugcccaaauuuggacaauagaaaccucuuaaaguugacagucauggcucacuacagccuuaaccuuccaggccugagccauccucccaccucagccucccaaguagcuggcaccacaggaaucuaccaccauaccuggcuaauuuuuauuuuuauuguagagacgggaucucccuacauugcucagucuggucuuggacuucugagcucaagugauccuccugccuuggccucccaaagugcuaggauuacaggcaugagccauggcacccaguugagcacuuuuuuauuuccuggcaaaauaagaauuucuagauuuaucuuguacuuuuucuuuuuuuuuuuuuuugagacggagucuugcuguaucacccaggcuggagugcaguggcgcuaucucagcucacugcaaacucugccucccggguucacgccauucuccugccucagccucccaaguagcugggacuacaggcguccgcuacugcgcccagcuaauuuuuuguauuuuuaguagagacgggguuucaccauguuagccaggauggucucuaucuccugaccucgugaucuacccgccucagccucccaaagugcugggauuacaggugugagccaccgcgcccggccuaucuuguacuuuuucuaugccagcucuccaaggagccccaauuccuuauuuuggugaaauccaguuuaucuuuuauggauuauucuuuugugccauauuuaagaaaucuuugucuaacacagguauuuuauccuguuuucuucuuggaagucccauaguuuugagguuuacauuuaggucuaugauccauuuugaguuaauguugguaugugguaugagauauggauccaaguucauuuuauacauggauaugcaguuuuucuagcauuguuguuagaggacuguccuuucuccacugcauugucauugucaaaaaucaguuguccgugcaugucuguguuuauuucuggacucucuucuguuccauuggucuuuuuguuuaucuuuacacuaauaucaugcuguugagucuguauuaaagccaagagaucuuaugucaggaaaacaauagggaagauguucugcaggaaauccuugugucuaacuguagaacuaaauuuagugacagagaaaaggggugacaaaguaguauauacuuguuaugcacccuaacaauguagguauaauacaguuauucaagaguauaagggauaucauuuaugugaauacuuccugaggaagcuguuagagaauuaaguuucagacagccaagaaaugguuuaauaggcucauugauugauuguuuuauaaaacuuaaccagggcaucaagagauauuacuacuuuaaauagaugcuguguguugugguaugggaauggugaggggggaagaauggagcuaauuucuauguugcuuauacuagggaaucaaaagauaguaucuaacaaagagaggacuuaaggauauuauauaaagauaaccauuaggacaaaagcccaaaccuuucuagauagcaaaagaaguauuggcagggggaaggagguggugggaaggguacagaaaggagagcaaaagaaacaaauacaaugaaauuauauauucucacugugacagaauugagaccauauagugauauuaguaaaugggcuuaacuggccuauuaagagaaaaaauauuuuuggguuaacauagcaaaauccaacucugugguuuuguuuucuuucguugcuguuuugagucugagucuugcucucucgcccuggcuauagugcaguggugugaucucacugcaaccuccaggguucaggcaauucuccugccucagccucccaagcagcugggacuacaggagcgaugcaccauacccagcuaauuuugguauucuugguagagaugacguuuugccauguuggccaagcuggucucgaacaccuggccucagugauccacccaccucagcaucccaaaguguuggaauuacaggcgugagccacugugccuagcccaacucugucuuuuauauaaaagauacaucugcaaaaucgaaaaacucaaagauuaggagguugggcaaagauaugccagacaaauauaauaaaaagggguuauuauaguuauuuugcgcaagguaaaacucaggccagaaaucauuaaagagguaggacacauuauaaauaaugcuacaagcugcagucuguaaugaagauacguuauugggugcauggauauucaugacagcuuucauuuaaaaaaaagaagcuucaggagagucauuaagaguuaggagcauauuaauaauagaagaccuaaaauccaucucaguucaagauagaucaacuggacaaaaacuucaguaaggcuauugaggaccuagauuaacacaacugaaagguagaucuuagggucaucuauugcauauaagagaauauacauuuuuguaaaugcgcaugggaugcucaugaaagaugauuauugagguacaaagaaaacucuuaaaaauuucucccaggccgggcgugguggcucacgccuguaaucccagcacuuugggaggccaagguggguggaucaugaggucaggaguccgagaccagccugaccaacauggugaaauccugucucuacuaaaaauacaaaaauuagccgggcaugguggcgugcgccuguaaucccaguuacucaggaggcugaggcaggagaaaugcuugaaccugggaggcggagguugcagugagcugagaucaugccacugcacuccagccugggcgacagagcgaggcuccgucucaaaaaaaaaaaaaaaaagaaauucccccaaaauagguacagcauuauacuuugacauuauacuuuuugggugaaacugaggaaaggaagauaauccauuauauugccggugggaaugcagaaugcuaaaacuggaagggaauuugguaauaucuaguaaaaugcaaaugcauuuccucauugaccuggcaaucuccacuucuaggaauguaucucagagauacaaaugcaaaauaauaaagugaggcgugcacaguguuauuugucuguagcacuguugauaauaauaaaagauugauaugaccaccaauaaaugacugguggaauaaacuaugguauauuacugugccgauguaaaaaaggaaugaaaaagauaugaauacugcuguggagugaauuccaugauguacuguuaaguagaaaucaaggugcagaagaaugaguauuauaugcuacccuuugugucucuguguguguguguguuucuuagcucuauccacuaaaaggaucuaaagcaacaguaucuccaugacaauaagaaaaagagaaaauaugugcuuauauuuacaaauaaacaacggaggccaggcaugguggcucacaccuguaaucccacacuuugggaggcugaggcaggagaacugcuugaacccaggaggcagagguugcagugagcggagaucaggccacugcacuccagccugggagacaaacagagacuccaccucaaaaaacaaacaacagaagaauaaauaauuaaaaaugacugcuagcgaggcaagaaaaaguugggaaggaauuagagaagaaaauuagaccucuguaaauguaacugguucacaguauugacuuuggaacuauguaaauguuuuaugaaacugaacaaauauaaguaacucucccugcuuccccagcaaacaaaacaaaugaacguuguucuguaucaaccagauaguuuuaccuacauaguaaaggauuuuugaaacugauuuuuaaaucacaauauugauugugcauuccuaguaugcuauauuguaagcacaaaaaaacuuauauugcauucagugguguguuuuuagugguuauguugguauuuugaaacuauucagguuucaugugagguaaagcaagcagauacuugugguaauaucauuaggcauagaaauucucaggauaaugaugaaggaaagcuccaggauggcagcuugcagcaggcuugaaaagguuuggagcuggaugaaggacuucauauuucagagaaggauacauuugagggcacaaauguaaaacuguuugauuagcugauauauuugaacauauugaaaaggguuugcaguucugucggaaaguuugcugcugauuuagugauaaauacuuaaaaacuaagcagauuuuuaaaaugcaggcaauugauaauucgagaaugaaauugcuugagaaaggaaauacuguacuaugcucugcaccucaguugugaauauuauuaaauguuuauaauauauaaacauguuuuauuuaucagauuuccaacuaaaauuauaaauuuguuggaaaacuaauagaaauaaaugucaggaggauaaggagggaaagauuuuuugauggggucuuaccuacauuuuccacuguaaggcuggacagguaagccuugugguuuauaaaucuuggaauguuguaauuuaaaaagaaauugguuuauguacuaguauaauuaaaggaaacugagaaguauauugauuaauauuauaggucaggguaaauuauuuuguuuugggcacagugguucaugccuguaaucccagcacucuggaaggcugaggcaggaggaucgcuugagacuaauucaagaccagccugagcagcauagcaaaaacccugucuuuuuauuuauuuauuuauuuuugaggcagcaucuuacucugcggcccaggcuagagugcaguagugcaaacacagcuuacuucagccuuuauccccugggcugaagugauccuccuaccuuagccucuugaguagcugggacaacaggugcaugcuaccacacccagcuaguuuuuguuuauuuuagaacucagggauucaugaaugggcaguaucaguugagcaaguggcucagugcuccaaagaaggggcaggagagggaaacuuugauaagguguucuuggcaucaagacaguagaaaguaccuaguuagaggcuaguuggcaguuucugauucauaaagucacuagagguuaguuggugguuucugauuaguuaagcuuaaguucacuuugaguuugguuucuuuuugcuuaaauaggaacccaaggugcuguggccaucucagcauaguggccuuccaauucauuauuuuaauagggauuaagaagacuaaaaguuaaggcuccauccuugacuuuuuaaaaaagcuuaaucuucccuuaacaaauucugucaauucuccuuucuacaucucagaaaucgguugccuucuuuuuaucuucauuuccugaggucauuucagcugcuuccuaauuguccuuccuaccucugagggugccuucucauuuuuguugaagaggucuccccaccaugaacugaaaacuuaggaugcuuaagcuuuucaaaaagugugagggaaacacauguacaauuaacauauuaagugaauaauuauauaaccaccacuuagaucaagaaacacacauagccaguaaccccaaaaguuccuugucugcuauauuuuuaucacuccuucccuuucccuuagaaguuaaccguuuguccaaccuuuuuuuuuucuucuucuucuucuuuuugacagggucuugcucugucaccuaggccagaguguaguggugcaaucagggaucacugcagccuuuaucugccagguucaaaugauccuccagccguagacuccugaguagcugggcgugugucaccaugccugaaugagacggaguuuugcucuuguugcccaggcuggagugcaguggcgggauguuggcucaccgcaaucucugccuccuggguucaagcaauucuccugccucagccucccaaguagcugggauuacaggcaugugacgccuggcuaauuuuguauuuuuuaguagauaugggguuucuccauguuggucaggcuggucucgaacucccgaucucaggugaucugccugccuuggccucccaaagugcugggauuacaggcgugccacugcgcccggcauuuauuuuauuuuuuaauuuuauuuuuuuuugagacagaguuuugcucuuguugcccagacuggagugcaauggugcgagcucagcucacugcagcuucugcccccggguucaagcgauucucccaccucagccuuccaagcagcugggauuacagacaugcgccaacaccuccggcuaauuuuuguguuuuuaguagagacaggguuucgccauguuggccaggcuggucucaaacuccugaacucaggugauccacuagcuucagccucccaaagugcugggauuacagguguaagccaccgcacccgggccaugaauuaaguuuuuaaauuuuuuuuuguagugacgaggucucacuuuuaccuaggcuggucuugaacuccugaggucaagcaguccuaccaccucagucucccaaaguucugggaauacaggcgugaggcacugcacuuggccugccccacuuuuauguuaacaauuccuucauuuacguaauggugaaugcuguaaccuagcuuugucuguuuugggacuuugugugaaaggaauggugcugguguauuuuauuucuuccuaucuucauuuaacauugaagggaucauccauguuguugcauauagcuauaguuuauucauuuuuaaugcuauauaauacuuugcacaaauauaccacaauuaaauuuuccauucuguuauugcuguguauuggaaauguugccuguuuuuugcucuuuuuaaagcaaugaagcuauuaacauucuuguuaauauauccugcuguucguauaugugaguccugagguuuugguguguggguguuuuuuuguuuuguuuuguuuuuuuaaauacgguaaggcagaauuccugaucauagagaaggugaacgcucaaguuaacuuaccaacucucauauacccacuagcaguucauguauguuccuguuggcucagauguagauguucacuaacauuuuguauuaucaaucuuuuuauuuuuuggcaaccucguggguguuuccuguuaacuuauugggaucugagaagcuuuuccuaaguaccaguuagguugagcacuuuccauauccaucauuuagauuucagcuauugugaagcacuuguuugagucucuccuauuuuuucuuuuuguuggguuauuuaaacuuuuuuuuucauuuuuuaaaaaguuauuauuauuauuauuuuuuaagacagaguuucacucuuguugcucaggcuggagugcaauggugugaucucagcuugcugcaaccucugacccccagguucaagcgauucuccugccucagccucccgaguaguagggauuacaggcaugcgccacuacgcccggcuaauuuuguauuuuuaguagagaugggguuucuccauguuggucgggcuggucucaaacucccgagcucagugauucaccugccuuggccucccaaguuauuauuuuuuuuaugagacuugaucuuguuguguuguccaggcuggucucaaacuccugggcucaagcaauccuucugccucagccucccaaauaucugggaugacaaguaugcgccaccgugucuggcuauuuuaauuuuaauaggaguuauuuuauauucucgcuaucuucuuccauucuguuugccuuuuuuauagggucuuuuauuuuuugaauuugaauuuuugaauuuuaugaaucucugugguaaguacucucguuuuaagaaucuuucugggcugggcgcuguagcucacaccuguaaucccaguacugugggaggaucacucgagcccaggaguuugagacuagugugggcaacauagggagaccuuaucucaauacaaacaaacaaacaaacaaaacgagccaggcaugguggcacaagccugugaucucaacuacuugagaggcuaaugugggaagauugcuuggacccaggaggacccagggcugcagugagccuucaucauaccacagcacuccagccugaguaacagagcaagacccugucuccaaaaaaaaagaaaaaagaaaauauuuuauuuuaaaagcucuauaauuuuuccuucacauuuggguuuucguuucaucugcaguugauuuauguguauggugagguugcaguccaguuucacuuucuaccugcuauccaagccccauuagcggaaaauaguaccauucuuuucccagugcucuacaccgccgugcuuauaauuauguaugcgugagucuguuucuuccuuagcgucugauuucucuuucucaggcaguuuuaaucuguugaucuauuuguuacuaccugcaccagggccacacuuuuuuuuccuuuuagaaaaaagggucuugcuauguugcccaauuuggucucguacuccugaccucaaauuguccuccugucuuggucuugggauuacaggcaugaaccacugcuuggcccacauucucuuuacaguaguuuuugacagcuggcaaagcaaguccuuauguaaccccuuaccaauaccuguaauuauuuuucagaagcaucuucuaauuguuuuuuagcuauuugaauuaucacauaagaauccaccugucagguuucacaaaaaaacaugauaggcuauugggauuaugagaaauugauaaaaaaaaucacuuuggggagaauauuauuaugcuucuuaauuuuuuuccuuuaagucagauggguagcgugguagcauccuaacaaaguuugaaggaggcacaucguacacauaugccugaaaaccugaucaucaugcuuaugaaccacaaaaggaucuuaugcuuucuuuaccgacucguuaaguauaauuauucccauugagauuuugcaagucuucucuuaaaguuuuucuagguacuugauagguuaugaugcuacuguaaaugauauuccauuuuaacuucauucuaccuuuuuguuccugguaaauauaaauacaaaugugugggguuuuuuuuccuuuuuauuauuuuuuguagugauggugucucacuauguugcccaggugggucuugaacuccuggacucaagugauccucucacuuuggccucucaaaaugcugagagcuuuuggccacugugccuggcccaaauauguuuuaugucuuaauuuguuuuuguuuuuuugagccacagucuccuucugucacccaggcuggagugcaguggcacagucagggaucacugcagccucagccuccugggcucaagucaucuucccaccucauccucucgaguagcugggacuacaggcauguaccaccaugcucagcuaauuuuuccucauuuuuguagcggggggggucucacuuuguugcccaggcuggugucaaaucccuacacuccucuggccucaaaugccuacacuccucuggccuuggccucccaaagugcugggauccuaggcauuagccacugugccuggacccaaauguuaaaaaauuuuuuuuucaauaacuuuguuaaaucuuucuaauucuaguaaguucucuguagcuuuguuuggcuucucuuguaucuaaucauaucaucugugaauaaugacaguguuuauuauuuccaaucuuuaugccuuuucuuuuucuugcuuuaucaugcugccuaaauucuccauuguugaauaaaagucaagccaguggaaauuuaucuuguuccugaucucagaaaggaagcuucaacauuacaccauuaaauaggaaguuugcuguaggauuuuauauagaucuuuuauaagcauauagauauucccauuggugagggagggauuccugccauaggauuaugagguuggcccaauacauaacaacugacacugggcagaugaaauugacaacaguuuauuagucacauagacuuguauagcccuggggaggacacuacauugccaggcagggccacaugaugguugcacuugggacggaguaaacaaacagggacugugggagguagccuuuuuauguaguaucaugaaaguggggugccccugguucccacaggaggaugagauuggcuuguuugaauaauuauauagguuggcaaggaacugaaacucaauauuuaagcauaagcagaaauugugccuggucgcuuugauaaagaguauuugguuaagggacccucucuguggaaguagaguggggaggagaacuugugguuaggcuguucaaaguccucccgguuuuaccagaaucaaggcaguacauaauauugaaccucaauucuaggccauauaccuccccauuuauuuucuaauauucacagaggcaugugugucugugaguguaucuuuuugaucauaaauagauuuuuuuuuuuuuugagacggaguuucgcucuuguugcccaggcuggagugcaauggcgcgaucuugucucaccucaaccuccgccucccggguucaaguuauucuccugccucaaccuccugaguagcugggauuacaggcaugugccaccaugccuggcuaauuuuguauuuuuaguagagaugguguuucaccauguuggucagacuggucuggaacucuuacccucaggugauccacccaccuaggccucccaaaguacugggauuauaggcaugagccaccacgccuggccuuagauuuuuuuuuuuuuaauauacuuuuucuuauguaucuagugaaagcauaauuguuccuuuaaucuguuagguggugaguucuaagaauugauuuucuaauaguaaaauaaacuuuccuaggcagaagucuacuuugugauggcauauuauucuuuucacaugcuguaggauuugguuugcuaauacuuuguuuauuacuuuuauguuuaugaauuaccuuggccugugguuuuucuuuguaauacugcccuuaugaauuuuuuuguagaguuaggcgaacuucauaaaaugaauuacagagugcuacugauuuaauuucccugaaggaauuucaugauacuuacaaucccuguguaaguuuggaauuaaaguauuucuugaauauaugguagcagucagggacugggccuuucuuugugggaagauuuuaacucuggauucaguuuucguaaagguuuaucuauaggacucuauucuacuugagauacuaugguagacaguuucuuuuuuucuaggaauuuauacauuuuauauaaauuuucaauuuuauugauauagguaguugauaauaaccucuugguaauucuuucucugugucaucuaacguuaugaauuuucuuuuucauucccagugcugauuuuauaggccuucccuauuucuuucucuuuccucaauauggauuuucaauuuuauugguuucuuugaaaaaauacauuaaucguucuguuucauuuuauuaauuuccuuuuauuugggaauauuuuacuaugccuugucaauguuuugaguacuuuuuuuuacaguaguaaaauauacauaacauaaaauuuacuacuuuaaucauauucaaguauauaauucuguggcauuaaguacauucauaguguucuguaacuuucacugcuauuuccagaacuuuuucaucauccugagaagaacuuuuuuuuuuuuuaauuauacuuuaaguucuaggguacaugugcacaaugugcagguuuguuacauauauaugcaugugccauguugguuugcugcacccauuaacucaucauuuacauuagguauuucucuuaaugcugugccucccccauccccucaccccaugacagucccuggugugugauguucucugcccuguguccaaguguucucauuguucaguucccaccuaugagugagaacaugcagcauuugguuuucuguuugcucagaaugaugguuuccagcuucauccaugucccuacaaaggacaugaacucauccuuuuuuauggcugcauaguauuccaugguguauaugcgccacauuuucuuaauccagucuaucacugauggacauuuggguugguuccaagucucuccuguugucaguagugccacaauaaacauacaugugcaugucuuuauaguagcaugauuuauaauccuuuggguauauacccaguaaugggaucacugggucaaaugguauuucuaguucuagauccuugaggaaucgccacacugucuuccacaaugguuaaaccaguuuacacucccaccaacaguguaaaaguguuccuauuucuccacauccucuccagcaccuguuguuuccugacuuuuuaaugaucgccauucuaacuggugugagaugguaucucauugugguuuugauuuguauuucucugaugaccagugaugaugagcauuuuucauguguccguuggcugcauacauguuuucuuuugaaaagugucuguucauauucuuugcccacuuuuugaugggguuguuugauuuuuuucuuguaaauuuacauucuuuguagauucuggauauuagcccuuugucagauagguaaauugcaaaaauuuuuucccauucuguagguugccuguucacucuaauggcaguuucuuuugcugugcagaaguucuuuaguuuaauuagaucccauuugucuauuuuggcuuuuguugccauugcuuuugguguuuuagucaugaaguccuugcccaugccuauguccugaaugguauugccuagguuuucuucuaggguuuuuaugguuuuaggucuaacauuuaagucuuuaauccaucuugaauuaauuuuuguauaagguguaaggaagggauccgguuucagcuuucuacauauggcuagccaguguucccaaaaccauuuauuaaauagggaauccuuuccccauuucuuguuuuugucagguuugucgaagaucagaugguuauagaugucugauguuauuucugaggccuguauucuguccuacuggucuguaucucuguuuuggucccaguaccaugcuguuuugguuacuguagccuuguaguguacuuugaagucagguagcaugaugccuccagcuuuguucuuuuugcuuaggauugucuuggcaaugcgggcucuuuuaugguuccauaugaacuuuaaaguaguuuuuuuccaguucugugaagacagucauugguaacuugauggggauggcauugaaucuauaaacuaccuugggcaguauggccaauuucacaauauugauucuuccuauccaugagccuggaauguucuuccauuuguuuguguccucuuuuauuuuguugagcagugguuuguaguucuccuugaagagguccuucacaucccuuguaaguuggauuccuagguauuuuauucucuuugaagcaauugugaaugggaguucacucaugauuuggcucucuguuugucuguuauuggcguauaagaaugcuugugauuuuugcaccuugauuuuguauccugagacuuugcugaaguugcuuaucagcuuaaggagauuuuggacugagacaaugggguuuucuaaauauacaaucaugucaucugcaaacagggacaauuugacuuccucuuuugcuaauugaauacccuuuauuucuuucucuugccugauugcccuggccagaacuuccaacacuauguugaacaggaguggugagagagggcaucccugucuugugccaauuuucaaagggaauuuuucaaaggucaguuuuugcccauucaguaugauauugacuguggguuugucauaaauagcucuuauuauuuugagauacguuccaccaauaccuaguuuauugagaguuuuuagcaugaagggcuguugaauuuugucaaaggccuuuucugcaucuauugaaauaaucauguaguuuuugucuuugguucuguuuaugugauggauuacguuucucaauaugcauauguugagccagccuugcaucccagggaugaagcccacuugaucuuggugaauaagcuuuuugauaugcugccggauuugguuugccaguauuuuauugagaauuuucacaucgauguucaucagggauauuggucuaaaauucucuuuuuuuguugugucucugccaggguuggcagauuuaugaugcuggccucauaaaaugagauagggaggauucccuguuuuucuguugauuggaauaguuucaaaaggaaugguaccagcuccucuuucuaccucugguagaauuggcugugaauaugucugguccuggacuuuuuuucguugguaggcucuuaauuauugccucaauuucagagacuguuauuggucuauucagggauucaacuucuuccugguuuagucuugggaguguguauguguccaggaauuuauccauuucuucuagauuuucuagcuuauuucuguagagguguuaauaguauucucugaugguaguuuguauuucugugggaucgguggugauauccccuuugucauuuuuuauugcaucuauuugauucuucucuuuuuucuucuuuauuagucuugguaguguucuaucuauuuuguugaucuuuucaaaaaaaaaacagcuccugaauucaugaauuuuuugaagggguuuuuugugucucuaucuccuucaguucugcucugaucuuaguuauuucuugccuucugcuagcuuuugaauuuguuugcucuugcaucucuaguuccuuuaauuguaauguuagggugucaguuuuagaucuuuccugcuuucucuugugggcauuuagugcuauaaauuucccuccucacacugcuuuaaaugugucccagagauucugguacguugugucuuuguucucauugguuucaaagaacaucuuuauuucugccuucauuuuguuauguacccaguaaucauuuaggagcagguuguucaguuuucauguaguugugcgguuuuaagugaguuucuuaguccugaguucuaauuugauugcacaguggucugugagacaguuuguugugauuucuguucuuuuacauuuacugaggagugcuuuacuuccaacuauguggucaguuuuggaauaacugcaguguggugcugagaagaauguauauucuguugauuugggguggagaguucuguagaugucucuuaggucugcuuggugcaaagcugaguucaagucuuggauauccuuguuaaacuucugucucauugauuugucuaauguugacagugggguguuaaagucucccauuauuauugugugggagucuaagucucuuuguaggucucuaaggacuugcuguaugaaucugggugcuccuguauugggugcauauauauucagguuaguuagcuuuucuuguugaauugaucccuuugccauuauguauuggccuucuuugucuccuuugaucuuuguugguuuaaagucuguuuuaucagagacuaggauugcaaccucugcuauuuuugcuuuccauuugcuugguagaucuuccuccaucccuuuauuuugagccuaugugugucugugcacgugagaugggucucccgaauauagcacacugaugggucuugacucucgauccaauuugccagucuuugucuuuuaauuggggcauuuagcccauuuacauuuaagguuaauauuguuaugugugaauuugauccugucauuaugauguuagccgguuauuuugcccguuaguugaugcaguuucuuccuagcaucgauggucuuuacaauuuggcauguuuuugcaguggcuggucucaguuguuccuuuccauguuuagugcuuccuuuaggagcucuuguaaggcaggccugguggugacaaaaaucucucagcauuuucuugucuauaaaggauuuuauuucuccuucacuuaucaagcuugguuugacuggaugugaaauucuggguugaaaauucuuuucuuuaagaguguugaauauuggcccucacucucuuggcuuguagaguuucugccgagagauccacuguuagucugaugggcuucccuuuguggguagguaaccugaccuuucuuucuggccgcgcuuaacguuuuuuccuucauuucaacuuuggugaaucugacaauuaugugucuuggaguugcucuucucgaggaguaucuuugugguguucucuguauuuccugaauuugaacguuggccugccuugcuagguuggagaaguucuccuggauaauaucccgaagaguguuuuccagcuugguuccauucuccccaucacuuucagguauaccgaucagacguagauuuggucuuuucacaaagucccuuauuccuuggaggcuuuguucauuucuuuuuacucuuuuuucucuaaacuucucuucucgcuucauuucauucauuugaucuucaaucacugauacccuuucuuccacuugaucguguuggcuacugaagcuugugcaugcaucaccuaguucucaugccaugguuuucagcuccauaggucauuuaaggucuucucuacacuguuuaugcucguuagccauucgucuaaucuuuuuucaagguuuuuagcuuccuugugauggguuugaacauccuccuuuagcucggaaaaguuuguuauuaccaaccuucugaugccuacuucugucaacucaucaaaguuauucuccguccagcuuuguuccguugcuggcgaggagcugcgaucuuuuggagaagaggcgcucugguuuuuagaauuuucagcuuuucucugagcagaacuucuuuacccauuaagcaagaacuccucccuauugccccuuccuccuagccccugguaaccucuuuucugcuuucacaaauagaacuuuuuauuugccacaauuagaaaacagauuauuggacugugguucauauccaacagcucauucaacauuagcacguaucucauccccaguugcuuuuccagcacugcuaccuucacugugaagcuccaugaguuuuuccaguucaaaccugggcuucuucagcauuuuuacuuuucuacugaaaacaucauggagaggagaaauagauuggcaagccuuuucuaugucuuuuccagugcuauccggaaucaauguauugaccacaucuuucaagucauuugucuguaccugucaggucaugauuuccagcaucuucuucuggauuuggcagaccuguuggugcagagcauaagagaucuuccguaucugauuguugguuuuuuuaguaaaaccaauacagaacaaaugaaacaaguaaucauaaguaguagucuugaugucaacaugagcuucaaucauggugugccauuuuuucacccuggaacacauuuuguccuggaguaagacccaugccauggaaguuaagucaggcaauuuuugcccugaacaucuuugauaaucaguuugaauuuucuaaaugcaacuucaucauucugcaagucaacaaagacucacugcaaacacauaacccuugagaccaucagaugcaauuuuuguuccuugguuuuggugauuagugucuuucugauauuucuuggacauagcaggagcuuucacaucauaccaaucuuucuaagaaaauggaucaacuaccuuuuuggcucccuuugcugccuuucauaaggugcuuguucuugacaacugcuaucgugcugcuccucuuuccuucuguccuugggaguuugccuauucuagaaccucauaaaaauagaauuaugcaauauuuguccuuuucuggucugacuuauuuccuuuagcauaguauuuucaaguuuuauccauagcauagcacauaucagacaucacuucuuaugggugaauaauacuccauuguaaggguauagcacauuuuauuuacacauugaucuuuuaguggauauuuaggcugcccacucuuuagcucuuacgaauaauacugcuacgaacauugguguccaaauaucuguuagucccuguucuucaguucuuuuuggguguauaggaguagaauggcuguuagcuuuuuggugaacuacaaaacuguuaccacagcagcuccaccauuuugcaucgugucagcagugcacaagaguuauagcuucuccacauccuggacaacauguauuuuuccuuuuauuuauuuaauuuuuuggaugagagccaucccuagugggugugaagugguaaucucauugugguuuugauuugcauuucccaaaugauguugaaaaucauuucaugugcuuguugguugcuguuuuuuuuuugaucuucuuuggagaaaugucagauaggcacaguggcugaacacuuauaaucccagcuauuugggagucugugguggcagggucacuugagcccaggaguucgagaccagacugagcaacaaagggagacccugucucuacaacaauguaaguaaaaaaauuuagccaggcauggugguacaugacuguagucccagcuacucaggaggcugaggcaagaggaacacuugagccuaggagguggaggcugcagugagcugugauuguuaucacuguccucuagccugggcaacaggauaauacucugucuccaaaaaaaaaaaaaaaaaaaaaaaaagggaaagaaaauaaaugucuauucaaguucuuuaccuauuuuugaauuuuuguuguaaaaguuuauauauccuggauacuaagcacuuacaagauacaugaugugcaaauauauucucccauucugucgguugucuuuuuuaccgucuugauaauguccuuugauguacuguaguuuuaauuuuggugaaggggacauccugcaaaguagcagaguaggaauuucuaggaguuaauccuuacauugaaacaaccaguaaacuggaaaaaaugaccagaaucaacuugcagucuguggugccaggggagugcuugaugaagggagaggcuacugcucuugcagaauaguuuggggaaagucucaaauggacugugccagccaucaacaagcaaaaauaagccaucccuuagacguuggaaaauuauaguuguaaaguuaccgcaguaacaagaucugaguuuauccugcuuggagcuuauugagcaucuuacaugcauggauucauguucuucaucaaauuuaggaaguuuuuagguauuaauuauuccauauguuuuuugccucuuucucuucuaggacuuguucaaugguguuccacaggugccuuagguucuguuaauuuuuucuuuauuuuuucauuuuaaucuucagacuggauaauuucaauuauuuuaucuucaaguuugcuguuucuucuuccugcucaaaucugccauuguacugcuguaugaauuuuucauuuuagcucuugggcuuuucagcuucagaauuucuuuuugguucuuuucuauaaugugugucucuuuacugacauucccuguuuguucauauacucuucugauauccuuuagcucuuugugcauaguuucuuuuaucucacugagcauauuugagacaguugauuuaacaucuuugacuagucguuucacugucugggcugucccagggauaguuuucugugaaauuauuuuuuuccuaugaaccagcuaugugcuaugauuuauaauucguuuguugagaaccaaacaauuuaaguauuacaauguguugguaacucuggaaaacagauucuccuucuacucagggauuuauuuuguuguuuguugaggucuaaaguugucuauuaguauagugacuuuuccaagaaauuuuugcgaagucuuuguuccuuguuauguauguuacugaaguuucugucccauuaucucuguaucugcuugcagccucucauauuuuaagaugucuggauuuuuuaaaaauaguguguaauccuuuuuaaguguucugauagaugucaccagagaagccgcuguaagccuaagggggucaaauauaaccaaccaucucugcugauccucagggaacugccauaccaauuaaaucacacuccagcauuuuagagcacaaagucuuuacuguucacuauagcaacagcgagccauucuaggaacgcuguccccauguugcagcaggacuauggaaugggucaugguagcugguuuaugcaugccagucucuuaccaaagguaagacagucaccuugauaauaccaauaaccuuaucacagcugucuaaaaugguauuauuucccaguagucuaauacaaguccaucuuccauuuuuccccuuuucccaaaaaugcccuuuauaucuguuuuauuauuguuguuguuguuguuguuauuauuauuauuauuuuggagauggaguuucacucuuauugcccaggcuggagugcaauggcgcgaucucagcucacuggaaccuccgccuccuggguucaagugauuaucucgccucagccucccaaguagcugggauuacaggcaccugccaccaugcccagcuaauuuuuauauuuuuaguagagaugagguuucaccauguuggccagucuggucucagacuccugaccucaggugaucuguccaccuccaccucccaaagugcugggauuacagggggccgugagccacugcgacugguguuauuauuuuuuaaauagagacagggucucacuguguugcccaggcugcucuugaacagcuggccucgagugacccucccgccuuggccucccaaaguguuaggauuacaggcaugagccaccacaccuggccauguuucuguuagucuggaauuacuucugugauuaacaugaaugguggcucaugccuguaaucccagcacuuugggagguugaggcaggaggaccacuugauggcaagaguucaaaaccagccugggcaacauagcaagaccccuucuguguuuuaaaaaagaaaaaaagauggaacaacaacaaaaagaaagauguuaaaccuuacaauaaggagugugucaacuaaaacuauaccaauauagcuauuuuucaccuaucaggcaaaaauccaaauguuuguuaacauacucuauuugagacuuugagaaacuggauauuguuauacauucccaacaagaguauauuugguuguuucuaacaaaauugcagguuuuuuuauccuuugacccacaaacccacuucuaagaauuuauuuuaaggguacaucugccacuaguaaagugacauguagacaagaguuauucauugagucaucauuguaauagcaaaaaaugggaaauaagcuguaaaaaagacugguugagguacauaccaugugaggaaaaaaagaaugcagguagaucuguauucacuguuauggagugaucaccaggauguauuguuaagugaaaacaacagcaacaacaacaaaaagcugcaguacaauguuuuuugcaaaaagaacuucuaggaaaaaggaaaaagaaauauucgcauaccauggcuuaauaaaaaugauuauuuauagggaaggugaaguagggcaaauggaauugagugauaaagauggaagagaaauuugcuauacuuuuuaauaaguuuuugacuuuugaaccaauguaaauguuguacauauucaaaaauaaguguauaucuaaacuaaaaguaaacucuaaaaguagugaaccuacaaaauguaucgaauuggcaacauagcagcauauugugggauuuuauuauugauucugacagucuguuucaacuaaugcaucuuagucuuuaagaauauuucugcuggauuuaggauucugguuaggcaauuuuugcacuuggaagacagccuucuacugucuucugacuuacauuguagcugacaaaaguaggcuaacaggccuacuuuugucuuuuuucaugauaauucauccuuuuuucuuuguauuuaaggcuucucuuugucuuugauuucugcaguuuuaggaugguauauuuauuuucuuuaucuuuuuuuuauagggaugggaucuuauuguuuugcccaggcuggucucaaacuccuggccucaagcaauccuccugcuucagccucccaaaauguugggauuacaggugugagccaccauguccagucuagugugauguauuuagauguuaguuucuuuuuauucuacuugagagucauugaacuugggaaacuuguaggcucuguuacuucacuucuacgaaauucuugcccauuuuauuuucucucaguccauccuuuugagacucugauuaaauacuuguuauauaaucgauauguauaugucuguuucuggacucuauucuguuucauuguuuguauuucucuccuuucucaaauaccacucugauuacuguagcucuauccauaguaaaucuugaaaucaaguagcauaaguccuccaaauuugguauuuuuugaauuguuauugcuauucucugucuuuugcauuuucauuaaauuuuaggaucaguuuguuaguuacuacaaaaugauccccugcugggauuuuaauugggauugcauugaaucuuuagaucaguuuggagacauggaaucucaacuguguugagucuaccaaucuaauaauguuuuuaaugucucuauuuaggucuucuuuaaucuucauuuugugguuuuuacuauacauguccugcauaucuuugguuaauauuaccccuauuucauguagcuuuuuuugggaaugcuuuaggauuuuuugcauauacaaucacaucaccugugaauauaguuuuacuucuuccuuuccaaucuggauuuauuuauuuuuuauugugucuuuuugcacucacuaaaacaguuccgaacagaagugcuaagaguggacauccuugccuucuuccuggugacagcagaaaggauucuguauuucaucauuaaauauauauuagcuguagguuuuucagagauggucuuuaucagguugaagaaguuuccaucuguuguuagguucuugaaaguuuguuauggauaggugaauuuuucagauuuuuuuuuccuuuuuuuaauuguauuuucuuuaguagagaugagaucucacuauguggcccaggcuggucuugaacuccaggccuguagugauccuccugccucagccucgcaaagcacugggauuucaggcaugagccucugugcccagccaaaauuuuucagauuuuuuuuuccagauauauugagaugaucaaagaaggcuuuucucccuuauuuuguuaacauaaugaauuauuugaacgcucaaccagccuuguauuucaggaauaaacccugcuuaaucaugauguauauguauuuuuauguauuucuggguuugauuuucuaguguucuguuaaugauuuuuuguuacuuuuuguuuaugagagagauuguucuguaauuuucucuucuuguaaugacuguccaauuuuaguaucaggguaauacuggccucauaaaauaagguuggaauuauuucuuuucugaaagaguuugcuuagggauggucuuaccuuuuuuaaauauugaauagaauucaccaguggagcccuuugugucuagacuuuucuucgugggaagguuuuuuguuugguugguuugguuuggaucuuuuuuguagagaaggaguuucaccuuguuccccaggcuggucuugaaauccugggcucaagcaauccucccaucuuggccuuccaaagugccaguauuacaggugugagccaccgcgccuggccgaugggaagguuucaauuacaauuucuuuuuuuuuuuuuuuuuuuuuuuuugagaaagagucucgcucugucucccaggcuggagggcaguagcuugaucuuggcucacugcagccuccaccuccuggguucaaucucccugccucagccucccaaguagcuaggauuaggcagcuaccaccauguacagcuaauuuuuguauuuuuaguagagacaggguuucaccauguuggccaggcuggucucaaacuccugaccucaggugauccguccgccucggucucucaaagugcuagaauuacaagugugaaucaccgcgcccagccuguuguugguuuuugagacagggucuggcucugucacccaggcuggagugcaguggugcaaucucagcucacugcaaccucugccuccugggcuuaagccauccucccaccucagccucccaaguagcugggacuacaggcacacgccaccauaccuggccaauuuuuuauuuuuauuuguagaggugggguuucaccauguuguccaugcuggucuugaacuucugagcucaagugauccgccugccucggcuguccaaagugcugggauuacaggcaucagccuccgugccugacccugugugguuuuuuuauuuuuauuuuuacuuauuuauuuauuuuuugagacagggucucacucugucaccuaggcuggggugcaguggcgcaaucucagcucacugcaaccucugccucccaggcucaagccauccucccacuucagccucuugauccugucauucaacucacuugaguaacugggaccacaaucacaugccaccacuccuggcuaauuuuuguuuuuauuuuauuuuuuauuuuuuuucgagacagagucucgcucugucacccagguuggagugcaguggugcaaucuuggcuuacugcagccucucccuccuggguucaagccauccuccugccucagccucccgaguagcugggauuacaggcgccugccaucacaccaggcuaauuuuuguauuuuuaguagagacaggguuucaccauguuggccaggcuggucuugaacucuugagcucaagugauccucccacuuuggccucccaaaguacugggguuacaggcauggccagugugccuggcccccuguguggguuuagcuauaaauuuauuuacacguuuuauuuuccuguauauguuauaucuuggugaauaucucaugcaugcuuaaagaaugugccuucugcucacauuguuuuuucuuuuucuuuuucuuuuuuuuccgagacggaguuuugcccaggcuggagugcaguggugugaucucagcucacugcaaccucugccuccuggguucaagcaaugcuaccuccuccuccugaguagcugggauuauaggcaugcaccaccaugcuuggcuaauuuuguaccuuuaguagagacaggguuucaccauguugaccaggcuggucuucaacucgugaccucaggugauccuccugccuuggccucccaaaguguugggauuacaggugugagccaccaugccuggccugcucacauuguuuuuuuaaaugucaauuggaucagguuugauucuuuuguucaagucuucuauauguuuacugauuuuucugucuacugcucuauugauuucugagaggggagaguugaaaucaacaaauguaauguggauuugucuuuuuuuuuaauuuuuuuuuagcuguaucaauuucuacauuauauuuucagaagcucuguuaauuagaugcauaugcauuuaggauucugucuugaugaguuaaccccuuuaucauguucucacuuuaucucuuguaaauaguccuuguucuaaagucugcuuugucugagaguauuauuaaguccuccugguuucauauuaugaaggauguucacuguguacugguuaccauuuuagcccacuauaucuugggcuguauuuuuacuacuugccugaguccagugagucaaaacauuuauaagcacaacagguuacaugaaguccaguuuuauuacccacagaugggcagcaagggacaggagaagcuuagcauucauugcaaaucggucccucaaggcuugggaaagcugcccagagcagauggucucuugucuguggaucgcagcuaagggacccaggaaagaagguuuaugucccaggagcaacauguuucacugggcuaaagcauuggaggacauccugucugaggguggagggaaugacaggaacagaaacggaggcucuuccaaccagcuccuccuugucucaggaugcuucauucccagcauguuauacaguuacacaaagguguggggcagggcagggaacuggcuugauucaaggcaaccuggagcacugcccuguacaugugcuuauuauuugaauguguaucuguuagcauucuguuuuuuuuuuuuccuuuaaccucucucuauguauuugaaguagauuucuuguagauaguauuuacuuguuuuuuguuauuuauguauguaagagucaguacuauuagugguauugacaggaccacggacaacacuauuuugcguuauauauauccucucccuugucugucauggauguuggaauaaaguugcuggauugguggugauccauaucaugauccugucauuuaacucacuuguguugugaucuaccauguguaauaagagacuuuaaauccauguacaucucuuuuguggagcuaggcagucaaagaagugcgagccauuccuagcacauaaugucaaaacauaagcccugcauuaugcuuagguuuagaaacuaaaacuucacagaaaggagauaacaaaucauauucacaucucaaaacccaaaaacuugaaacauuucauuuguagaaaaaaggaauaagaggccagguaugauggguuaugcuuguaaucccagcacucugggaggcugagacaggcggauugcuugaggccaggaguuugagaccauccuggacaacauagugaaacccugucucuacuaaaaauacaaaaaaaauuaguggagugugguggcacaggccuguagucccagcuacucaggaggcugaagugggagaaucaccugagcccgagagguggaggcuacagugagccaagaucaugcugcugcauuccagcuugggcaaccagagugagaccuuguuucaaaaaaaaaaaaaaaaaaaaaggaauaaggccaggcaccauggcuuaugccuguaaucacagcacuuugggaggccaaggcaggaggaucccuugagcccaggaguuugagagcagccugggcaauacagugagacccagucuguacauuaaaaaaaaaaaauuauccaggcaugguggugcaguuuuggcaauuuuguuguauaaguaugauaggguguacuuacacaaaccuaugugguuuagccuacuacacaccaagagaauaugguacagccuguugcuccuaggcuacaaaucugcacagcauguuacuguacuaaauacuguaguauucaucuguaacgcaaugguauuuguauaucuaaacauaucuaaaaccuagaaaacuacaguguaaaagauaaaaaaaaaaagguacaccuguauagagcaguuaucaugguggugcuugcaggacuguaauuugcucugaaugagucagggagugagugaugagugcauaugaagggggccuagaacauuauauacuuuuauaugacuggcagcucaguaggcuuguuuacaccagcaucacccuaaacacaugaguaaugcauugcaccacaguauuaucaauauuaccacagcuuucacuaggugauaggaauuuuccagcuccauuuuauuuuuauuuauuuauuuuuuuugagauggagucucugucacccaggcuggagugcaguggcacgaucucggcucauugcaaccucugccuccugggguucaagcaguucuccugccucagccuccugaguagcugggacuacaggcacaugccacugcacccggccaauuuguguauuuuuaguagagacgggguuuccccauauugaccaggcuggucuugaacuccugaccucaagugaucugcccaccuuggcuucccaaauugcuaggauuacaggugugagccaccacacccggccuucagcuucauuauaauuuuaugauaccacugacauauaugcgauccauuguuggcuaaaaaaauguuaggcaguggccaggcguggugggucacgccuguaaucccagcacuuugggaggcugagguggacagaucacgaggucaggagaucaagaccauccuggcuaacauguugaaaacccaucucuacuaaaaauacaaaaaauuagccggcugugguggcacguugccuguagucccagcuacuugggaggcugaggcaggagaaucacuugaaccagggaggcagagguugcagugagcugagaucaugucacuacacuccagccugggagacagggcaagacuccgucucaaaaaaaaaaaccaguagcaacaacaacaaaaaaccgucaugcagcucaugauuguauuuacuguguaauauguagugcuuuguuuuucuaguacugaaaaaaaagguacaucuggggcuugggaaugaaguucugguagagauguaaauuuaggauuuacuaacauuugguuucaauuuguuccuuauuagguagagguauauccaugacucagaauuuauuuguagccuuagaggucauacuuugagggagucaauauagaugagauugugcugguccucaucuaccugauucagaaagagccagcuauugucaucugauuuuagcuggacgguacagggcuuacugcccagguuuaccagguaccagccuaggcuagaccuguucugugcauuuacucaugugaaauuguuacaacaauccugccucagaguuguucuaauggaaguggaauauugagcacacuaacuagaacacagcaaguucucaauagguuaaguaucaugaugauuaucauguauuacucuuuuauagaagaugaaaaagaggcucaaaaagauugauuaggaguuacagagcaaucaaugaagagggcuaaucuaggucuugaacaguuuuaaaguccaugcuauaucuccauuuaaauacuuacauuguagagugugcacaugacaugucauuagugguuaugugaccacgggccagucguagcacccaguuuccucaucuguaaauuggggguaacacuuaauguuuuauaaagaaugucuagaguucuuagcugugugaagcuggaggcauaaugaaaauuacguuuacuccaucuucucugaaaugcauugugacaucuuuccagauuuuaaguauuaauucuuugccaguacuguguguuuagauagaucuuccaucuugaggcuugucuucucauuuuguucaugguaauauuuucacuagcuguaguucuguaacaaaggugaauauauuaaucuuucccuuauagcucuugcuuuuuguuucuugcuuaaaaauuuauuccaauaaauuuguauuccaagaucacaaagauauucucuuacauuuucuugugaaaguuuuauaguuguuaaucuacuuaaaguaguuuuuuuuuuagaucagaugaaguagggaucuaauuucauuccccacccccaauaguuguugcagcaacaugaaaaguucaucccuuuucccacugauuucuagugaacaucugauauauauaaagugugcauuuauguaagccuuaaaaaaaucacaccauuuuaauuguuacagcuuuauaguagguuuuauuaguugggaggcguguccccucagcuugugaaaauucuauggaaauuucuguugggauuguuaauagaggugcuuugaaucuauagauauguuugugggagcauugguaucuuuaccaucaugaacaugcuuucuucaugauuuagauauuuuaaaauauuuuaaaauauagcuuaauauuuuccugcacaaugaccuucacaaucuuuuaaaauuuauuucuaaguacuuaauauauuuuuguugcuauuguaaaaaaauuuuuuuuucauuaaauguuuguuuguuguuuguuuauacauaugaaauuggccuuuggauuacuuuguauuuguucuuaugcauuucauuaaaaaauauaucugggaaccuuauugcagucuuccauaguuuaaauuauauggcaucaaguuuauauuagaguuuuuuuuuuuuuuuaauacuuuaaguuuuaggguacaugugcacaacgugcagguuuguuacauauguauacaugugccauguuggugugcugcacccguuaacuggucauuuauauuagaguuuuaacuuguuuguuauuuuuauuuauuguuuuuaccaagcacuacgaaagaccauucuuuuuuguucaaaggaauacuauuugcauuuguuaaaaggaaaugguguuuuacacucuguggagauuuuaaacaaaaggagcaugucuguguucuacuuccagaaauccuaauuuugcagaucuagagaaaaccugagcuccuuguucuuuugaaaaucucccauaugguucuguacguuucuguuggaaaaccacugcuagagaaguugcuaaacaguaaaagcauuuagcccaugaugaugugggggaagggaggcauuucauuuaaaauuaugaaaaauuuauuuaucauuuaauauuucaugugugauguauagauaaaauuaguauauuuacauagacaauuguuuuuaagugacagcagguaugaauuuaaaaagaauggacauugaaaaagaacaaagucacaguuugagauguauugguuaaguacucaguauauuuguauuaaaacuuagaauauaauuuuguuuuucccaguuggagucauucguugcccaguuugcagccaagaaugugcagagagacacaucauagauaacuuuuuugugaaggacacuacugagguucccagcaguacaguagaaaagucaaaucagguaaguguauuacaucuugaaccuuuugccugccagcucuuuuuuuuuuuuuuuuuuuuuuuuuugagacagagucucauucauucuguugcccaggcaggaguucacaaguggcgcaaucuccguucacugcaagcuccuccccacagguucacaccauucuccugccucagccucccgaguagcugggaccacaggcgugucaccaugcccggcuaguuuuuuguauuuuuaguagagacgggguuucaccauguuagcuaggauggucucaaucuccugaccucuugauccgcccaucucagccucccaaagugcugggauuacaggcgugagccaccgcaccuggccucuuuuuuuuuuuuuaauugagauggagucuugcguuguugcccaggcuggaguacaguggugcgaucuuggcucacuuccaucuccuccuccuggguuugagugcuucucucaucucagccucaugaguagcugggauuacaggugugugccacuaugcccagcuaauuuuuguauuuuuaguagacauggcauuucaccauguuggccaggcuggucucgaacuccugaccuugaguaauccacccgccucggccucucaaaguguugggauuauaggcgugagccaccgugccuggccucuuuuugccaacuauugaugaggcaaccuaaaaugcuggagaucucuaaaauaaaaggagccaaacauuaguuaauugaucuauaaaguuauauaacauuuuaaaagaauauaaagaauaaugaauaauucaccuuaagaaauaaaacagugaaacagugacaguccagaagcucuugauugcauacccacauuccagucuccuccagagaaaccauuauucuauauuugacauuacuucauuucuuuguacuuuuacuguguauugacaaugagauuuuuauuucaagcucaguuuuucacuuuuuuucuauuuuaaugauaagcucuauaaugauacaugugaaagacaccaugucuuugaucaguaagguuuuuacauuuuuaagaaagccuucuuuucugcauggucuuacuuugaaagcuucauuuguuuuuuggggguggugguuguuguuguuguuguuguuguuguuguuguuguuguuguuguugagacagggucucacucuguugcccagucuggaguucagugauguagucguagcucacugcagucuccaacuccugggcucaagugauucucccaccauagccuccugagucacugggacuacagcuuuaugccaccaugcccaacuaacuaaaggcuuacuuggcagcauuguccaagguguuggauuuagagauccaaugguguuuuucguuuguuucuaauuucuauaacccacauguagaacaucucuuuuggcuucuuaaaucuagaugucaaaucuaucaugcauaaucuauaguacuccaguggggguuagccauguugagauuaauucuacaguuugugcuaaguauaguguguuagucuacuuuuggaucuugauucauugaugauuccucuaacaguucccuuaacuuggaacagaagaucugggaaagaacuaaaucugguuagggaaaagcaguuguuagcuauguuuuucaggacucuaguaaucacaugguuaauuucuguacuuuuuguugaauuuuuaguuuuuuguuccuugguagaacuacaggaauuuaagguucacuuuaaaugaacauagcuacuacugacuaaaauaccuguuuuuguaguuuggaaaguauccacaauucuuccugaugugaaccuugucaaaggccaaaacagacacgcuugcugugggagauaaacuuucuaauuguuuaauugugaaaccacccuuaaagaaagaaacauauuuauguaggcuacaguguugagcacuuaaguccucugaaaguucucuucuaaauacaaaugauuuuguuucugucuuccauugcaucaugucacuuugcuuuacaugugauuauagcuauucuagauauucauuagucauauucauaguaguaucuguguaugcucaauccagaaaacuaaaaaauacaguagcauaaguaaucuucaaauguaaaguagcauaaauaaaugucaaucagaugggauauuccuaugacauaaaaugaugauaauaggacaugagaguuaaagggauucuaauccaaaggacaaguuuaagaggcugcuuuauaccuccguaugaucaauuaguuuucaguacguuuauguuuauuuagucugcuucugucacagaaacauaguaggaagaaguuaaacuagagauggaguccaacauuuagacauccuaaauguugauacugggcaugcauggguuaggguaggaaaugugguaugagaauagggugcugcugggggcauuuggugaggauggagacuggagaugucauaugggggaugaauuugaaccaggcaguacuuagcaagagguagugggagcugaauuagcgugguagcaauaaggaaaggaaguuaccacccagagagaacuugauaugccugauuggguguggaaggugagagauguuuuacugccuggauggugccuuucacagacaucaugauaaagugggugggaguuagguagagauaauaaauugguuuugaaugggauugaguuugcauugccugugagacuguaaaguagaggugucauccaugguuagaguggugcucuaaagagaguucauagcuggagauuuugaaaaguuuuaaaaacuuuuuguuguagauaauuucaagcauuacuaaagaaacaguugacauaacaaacgcccauggacccaucgccuagaucaauagccaucaacucuuguuuugugcauacucugauacuacaccaccaaccacuagauuacauugauguuuauuccagccauuauaugauuucaucuguaauuuuuuuuuuuuuuuuuugagauggaguuuugcucuuguugcccaggcuggagugcaauggugaggucuuggcucacugcaaccucagucucccaaguagcugggauuacaggugcccaccaucacgccuggcuaauuuuugauacagagacaagguuucaccauguucgccagacugguugcaaacuccugaccucaggugguccacccaccucagccucccaaagugcugggauuacaggcauaagccacugcauccggccucaucuguaaauauuuugguauguacuucaguaaaauauuuuuucuguaaacauaacuaccauaugaauuucuauguaaaaauaaaaggaccagccugggcaacauggugaaacccugucugagcgaauaaaugaaugaaugaacaagaaagaaaagcaagcaagcugggugugguggugugcaccuguagucccagcuaguugggaggcugagguugcaggaucaccugugcucaagaagauggaggcugcagugagccauaaucaugccacugcaccccagccugggugacagagugagacccuaucucaaaaaaaaaaaaauuuuuuuuuaaaugcuuaaugaucucauuauuaucaaauaucuaagcaguaaucaaauggaucugaauauuauagguuuuuuuaaacaaugguuuguuucuauaaggauccaacaaggccuacacaguacauuugguugauuugucucaaaccuaauuaaucucaaguuaccccuuugcuucacuugcuuuccuuuucuuccuauuuaauguuuuuguugcauaaacugaguugcauauucaauagaguuagcuuuauucugaauuuugcugauaauuuccauaaagucauuuaacgugcugauuauauaucuugugaaacugaauaaaaauguaguggcuuguuuagguucugguuccguugugggagaaggguaagaauauuuugauccauauguccauguguaugcucaucaggaagcauauggugucugguugucuuucuuuuuuucugauguuaauggccauuaaugaucacugccaagauccuguauuucauuagggcuuugaaaaauagugacauuuuuauucuauuauuccucuuuauuucuuaacuggaauagaaagagaaagcuuccuucaucaauucuuugauuacccuaagcuauagugcauccaggaaaggucaguucaauuuugauuccuucccuuuaguugccaauuuuuagagcaguaaguuaauuucuuaggauucuucagaggugacuaauaagaggagugugugugugugugugugugugugugugugcgcgcgcgugugugcgugugugugugcgugugugugugugugugugugugugucacucuguuugagucugcaauagucauugcugucucccuugcuguuuuuucuguucuagaccuugaagcagccauuucuccuaggugccuugauuccuuuucaugggaaauaauauuuggagaccacaguaugguacggugggugcucaucaucauugaguuggucaccuaucuaggccuuucagggaaugaucuaacagagacuuuauuuauuuauuuagagacagagucucacucuguugcccaggcuggagugcaguggcgugaucuccgcccacugcaaccuccuccucccagguucaagcgauuuuccugccucagccucccgaguagcugggacuacaggcuugugccaccacacccagcuaauuuuuuguauuuuuagcagagcgggguuucuccauguuggccaggcugaucucaaacuccuaaccucaaguuauccacccuccucagccucccgaagugcugggauuacaagugugagccacugcacccagccgaaauguugguucuuaauugcauugauguaauuuguuuucucuaggaaaaaaaaguuuauauauauguauaauauauauauaauauauuauaugcauaauuuauaugcguaauauauaauacagucuuggugcaauuaggaaucauuuuaauucuuaaaauuaagaauuauaaggccaggcaugguggcuuaugccuguaaucccaauacuuugugaggccgaggcaggcggaucacaagauuaggaguuugagaccagccugaccaauauggugaaagcccgucucuacuaaaaauacaaaaaaauuagcugggcaugguggcaccugcauguaaucccagcuacuugggagggugaggcaggaaaauugcuugaacccagaguggguguugcagugagccaagauugcaccacagcacucuagccuggaugacagagugagacucugucucaaaaaaaaaaaaaaaaaaaaggaaaaagaaaagaaaaaaagaauuauagacuagauauaagauuuucugaaaagauacaaauacaauucuuaaaguaucacagagguagcaacuuugagaagcagcugagggaacaaaugcaaaaggauggaauuauuaaaagauaaaagcucagaggaagggccucguggaacuuaaacaccugagaaggaagugcaucuuggcuggugauggggucuggguguuuggcuugggacucaggcuucugacgggcagaaguaguggugcuggcaucucugaagugaauuacaguaaagcugguucuacagauauuggaaaaacugcaaacuagagcuagcuccauuguaggaaggaacugcugcaccugggaugaagcagcaucacuagugugaugcucacagaaguuacaugcagguaggaagaaaagaggaagccgacuaugagaaucaagugccuucuucugacauugcauucuccuuccagcacuacccguuguuagacucgaaugugaaaccagcuuguaaagcauaaauguugcuugcagaauaagaguuuauacuagaguggaguuggagcugaaaauagaaguuguagaauguuuguaucaaaacagaaagcaagaaagacagcaguuauauguaugcacuggagauauucaaucaaaucaugugugugugugguuuuuuuuguuuguuuguuuguuuguuuguuuuuaaagagaaggagucucacucuguugcccaggcuggaaugcaguggcgcgaucuuggcucacugcaaccuccaccucccggguucaagcaauucuucugccucagccuccagaguagcugggacuacaggcgcauacugccacaucuggcuaauuuuuuguauuuuaguagagacaggguuucaccauguugcccaggcuggucucgaacuccugagcucaggcauaccaccugccuuggccucccaaagugcuaagauuacagaugugagccacugugcccagccaaucaaaucauguuuuaaaguuaccugaaacaaauaaaucuucucugugcaguuaagucacccacuugauuaggcagguucauuuauuaaauuuugcuuuugacauuuaggaauuuaaauuuuuaaaauauuguauaacuacauguaaaacauucauguuguuugaaaauaaaaucuauaaacuucuaucccugucuugucuacccaucuaccuuauuucuucccaaccucauagguaacuauuuaauguccuuuauggauuauccuuccuuuuuaaauauuauguuaauguacaauuuaaaaauaaaucaucccacuccaucccaucuguaucacucuguuuuugcauugcuauaaagaaauaccugagacuggguaauuuauaaagaaaagagguuuaauuggcucacgguuucacuggcuguacaggaagccugaugcuggcaucugcucagcuucuggggaggccucaggaaacuuacaaucaugguggaaggugaaggggcagcaggcuugucuuacauguggccggagcaggagccaaaagagggugggaggugccacacacuuuuuucuuucuuucuuuuuuuuuuuuuugagauggaguuuuacucuuguugcccaagcaggagugcaauggccagucuuggcucacugcaaccucugccucccagguucaagcgauucuccugccucagccucccgagcagcugggauuacagaugugcagcuaauuuguuguauuuuuaguagaaacgggauuucaccauguuagccaagcuggucucgaacuccugaccucagguaauccacccgccucagccucccaaagugcugggauuauaugcgugagccacugcgccuggccaugccacacacuuuuaaaugaacacaucuccaugugaacucacuaccaugagaacagcaccaaggaggauauccacccccaugauccagucaccucccaucaggucccaccuccagcauuggggauuacaauucuacaugaaauuuggucagggacacagauccaaaccauaucauuccaccccagccccucccaaauguaauguccuucucacuuucaaaacacaaucaugccucccaacagucccccagagucuuaaccauuucagcauuaacucucaaaaaguccuaagucuuauauuugagaugagaaggacaagacaagucucuucucccuaugagccuguaaagucaaaaacauguuacuuccaagauacaauguagguacaggcauuggguaaauacucccauuccaaaauggagaaaucggccaaaagaagggggcugcaggccuugugcaaguccaaaacccagcagugcagucauuaaaucuuaaagcuccaaaauaauccccuuugacuucacaucugucauccaggacacacugguacuaggggugggcucccaaagccuugggcagcuguaccuaccccuguggcuuugcaggguucagcccccacagcugcucucauagguugcucucauggguugacauugaguaucugugacuuuuccagacuaaaggugcaagcugcuggugggucuaccauccuggguucuggaggacaguggcuuucuucucacagcucacuugggagggccccaguggugacucugugugggugcuccagccccacauuucuccucuguacugcgcgaguagagguucuccgugaaggcucugccccugcagcaggcuucugcuuggacauccaggccuuuccauaaaucuucugaaauccaggcagagagaggcucccaaaucucaccucaugcauucuguguaucugcagguuuaacagcacauggaagcugccaaggcuuaugccuugcacccugugaagcaguggccugagcuguauuugggccucuuugagccauggcuggaacuggagaggcugggacacagggagcaguguccugaggcuucucaggggagugagccccugagccuggccuggccuguaaaaccauucaguccuucuaggccucugggccugugacaacaguggcuccucagaaugucucugaaaugccuucaaggccuucccccuacccccaguuucugcagccugcuugaauuccucccuugaaaaugggcuuuucuuuccuaccacauggccaggcugcaaacuuuccaaacuuuuaugcucugcuucccuuugaaauaucuaaguuccaacuucaggucacuuauuugcucauacauaggagcauagguuguuagaagcagccagaucacaucuugaacacugcugcuuagaaaccagauacucuaaauaaucucucagauucagaguuccacagaucccuaaagccaggggcacaguccaaccaagcucuuugccaagguguaacaaaggugaccguugcuccauuucccaauaaguuuauuuccaucugugaccuccucagccuggacuucauugucauauuacuaucagcauuuuggucccaacaauuuaacaaaucucuaggaaguuccaaaauuuuucucaccuuccugccuucuugugugcccuccaaacuguuugaaauucugcccauuacccaguugcaaagcugcuuccacauuuuaagguaucuuuagagcagugccccacuccucaguaccgauuuucuguuaucagucuggucucacauugcuauaaagaaauaucugagacuggguaacuuauaaagaaaagagguuuaauuggcccaugguucuucaggcuguacaggaagcaugauccuggcaucugcucagcuuacgaucauggcagaaggugaaaagagcaggcucauccacauggcuggagcaggggcaaaaagagaggggggaggcgccacacacuuaaacaacuagaucucgugagaacucagucacuaucaugagaacagcaccaagggggaaaucacccccaugauacaccuaccucccagcaggccccaccuccaacauuggggauuacaguucagcaugagauuugggcaggcacacagauccaaaccauauuaccaucuuucuugaauaagcaguagcauuacacacacacacuuuuccuguuuuauuucauuuuauguacuaacaaucucuccugagugguguaaauagaaauuacuuauuucuuuuuauagcuuacuguggagauuacauucuagauuacauccuuuuagagaugcugugugaggcuaaggaaguagaugagaucaaucccuauaaucaaaaacuacagaaucagaggaggaagggugggauccacagugacaaucaggugagauaggaggauuggcagguauuaaggaauucacaugauuucuaggaagcagaagucacugguaucaagugauguuagaaagauugaagaugauaagagcagagaaaagguagauuuugguuuauggacauaucagguauuuggaauuugguuagugucaacugcugagugaaguggaaaaaaauuuuacugucaaaccuguucucaucuccacaucccacuuccagcaacccucaccaaagccacugaaaaauccuagcuugucauuauacagaaacacuugcuccuuuucuaauuuguucucuacauuguagccauugugacauaaaaaugcaaaucuggccgugucacuuucuuaaaagcuuuuaauagacuuauuuggacaaacaccaaaauugccuugugacucugcuuaaucuggccccugucucuuguccuagcuucuuuugccagucuuccccugaaucgcaccacuucagucauacuuaccuucguucaguucuuugaaccugccugcucuucuugcuugggacuuuuuguacaugcuguucucucuuccuagaaguaaaagccuucacuggguaaucccuccucaugcuuuccccagccuuccaaccccacuaaaaugagauccauuucuucaucauaugcucuuauaacuuuccauagauuuccuuuaugguaauucucaguuuguaauuauauauugaugugcuuauucuaauaauguacaucugccgcacauuuaaucuucacaacuacucaguaauaucuguauuauuacccucauauuaaagaugaguacucuguguaaccugcccaagaccacugagcuaguaagugagggaacugggauuuuaaccugcacuauguacaagacuguaguuaucauaagggcagcgaccauguuugcuuuuccugacuguucuguucucacaccuagcauaauguuugggaaauaccuaguugaaauauuugggaugcugaauuaaggagaaaauauacuuauauucuugucucuucacaguauuuucauuucuuauguguauaauguaacacacaaggucaguuuaaaauuucccaacaccauuaggaggcuaacugauuuagccugguacaauugguguaucauguacgcauagcucgagauaggaccaccuuuucauuuucucaaaaauuuacgugccaugguucuuuugucagguauguacaagcugugaggacaacgcagaagccaauggguuuuguguagaguguguugaauggcucugcaagacguguaucagagcucaucagaggguaaaguucacaaaagaccacacugucagacagaaagaggaaguaucuccagguaauaaaugagaucuuugcauuuuuuuccuucuaucuuuccccgucuuuucuuccuuccuguauugacuuguuuugacacauuuguuuugauaaguauuaaauauacuguuuuaaguaaaagagguuuauauuaucgaaauuuaaguacuuacaaauuuuggaaaguacgaauagauguagaacccuguuuuacauucauacugccuguccuccugcuucuauaaaugucuucaauuggugugaauauagaacaaauggagaaaaaaauugcuuuuucuuauuuuucuuuuaucucuaagauaacaacaaagagugggcuuaaauauuuuauaacucuuccuuuugauauucuuguuguaaaccugcaucaugauauuugucugauauguggauagccagagaggcuuuuuuauguaauuauuauuuccaguuuuauguaauuauuauugucuuguuuuuaauguacaguucacucauauguuuuuuauuuugguaaaauacaugcaacauaaaauuugucauuuuaacuacuaaauguacaauucagugguauuuauuacauuuacacauugugcaaccaucacuacuauuuucaaaacuuuuuuaucaccccaaucagcaucuuuguacccuuuaaguaauaacuccaauuuucuggccgggcgcgguggcucacgccuguuaucccagcacuuugggaggcagaggcagguggaucaugagaucaggagaucgagaccauccuggcuaacacguugaaaccccgucuguacuaaaaacauacaaaaaaauuagcugggcgugguggcgggcaccuguagucccagcuacucgggaggcugaggcaggagaauggcgugaacccgggaggcggagcuugcggugagccgagaucgcaccacugcacuccagccugugugacagagcgagacuccgucucaaaaaauaauaauaauaauaauaacuccaauuuucuuccccuagcuccuaguaacuucuaaccuauuuucuuuuuguugagagugagucuugcuuugucacccaggcuagccguagugcaguggcacgaucucagcucacugcaaccucugccaccuggguucaugcuauucuccugccuguaacugggauuacaggugugcgccaccauguguggcugaauuuuguauuuuuaguagacacaggguuuuaccauguuggccaggcuggucucgaacuccugaccucaaguaauccgccagccuuggccucccaaacugcugggauuacaagcgugaaccacugcacccagccuuuauuuucugucucuauaaauuugcugauucuagauacuucacgcaaguggaaucacaugguauuuguccuuugauaucuaacuuauuuuacuuagcauaauauuuuaaggauucauccauguaauagcauguaucaaaauguagcaaaaccguuuuguuuuuuuuuuuuuuuugagacuagugaaagacuugguguaaucccagcacuuugggaggccgaagugggaugauugccugagcccaggaguucuagaccagccuugccaacauggugaaacccuaucuacaaaaaaaaauuagcugggcgugauaguuacaugccuguaaucccaacaaccugggaggugagauggugggaggaccacuugaaccagggagcucgaagcugcagugaccugugauaauugccauuacacuccgucugcgcgacagugugagauccugucuccaaaaaaaaaaaaaccgucuuagcguugcuggaguuaauuccauauuucaucuugauguguugugcuuuuaauauucuugugauauauuggcugauuuuucucuaucugguuauuuucauuuucauucugaauucuauauguuuauauauuuguaucuucagaaauauuucuuguauuuaucuaauuaucaguuuuuuaguucauuaauuuuaucuguaauuccucucagguuaccuuaggguuuuuguguguguguguuuuguuuuguuuuguuuuguuuuuuuagacagaaucucacuccaugacccagacuggagugcaguggugcgaucucagcucacugcaagcgccaccuccuggguucaagcgauucuccuacuucaaccucccaaguagcugggauuauguaaucccuguaccaccaugccuggcuaauuuuucuauuuuuaguagagacgggguuucaccauguuggccaggcuggucucgaacuccugaccucaagugauccacccgccuugggcucccaaagugcugggauuacagaugugagccaccacgccugguauaggccagcauacugguuugucaauuuugacacuauugacauuuugagcuagauaauucuuuaucguuggggacugauuugugcauuauaaaaaaaaaaugcaaauggcugauuacugagcauuguuucauuucaguuauuaaagaaaugcauucuaagauaguaaaguaugugucuucucucuuucucucuugcuuucucucucgcauuuauuaaauugucaaaggugaaaaauuuugagaguucccccugugaauacaguuaauagccacucuacacugguugaaguacaaauuggcacaauuauuuagcuuuuuucuguaugaauuacccuuugacucaacaauuccaccacgaggaauuuaccuuauggaaacauuuaaaugauuuauaauuuucauauguuuauuucagcauuaaacuuucaaauauccuuagcaggugguauagugguauaucuauuucgugaaauacuauacaguuaauaaauaagaaugagauggauacauauacuaauacagaaagucaucuaagguagaguuaagugagaaaaaaaaucuuuaaaagacaauauauguacuaccauuuauuguuuuauaaaauguaacacugcacuauacuauauguacuuccauacuuagaaaaacaaccagaggagugcacaccagguuauuaauaguaauuaucucuggagguaagauuauuucugaaauguuuggauuuugccuuuaauuauuaguaagauaacugcgguuuacuauuuaaccauauuuauucauauucugauuuuuucacuuaacauuaugacauaaacauuuuccaguuuuauccccacacuggaaaacuagaguguaauaaugaaaacauuauuauuucuguguuaauggguauucucuguuaggauuuuuacaaaaguggguuauuugacuacuccuuuuaggcauuuuuauuauauuuucuuucuuccucccucuuuuuccaucucuuucucugccucucugucucugucugugaggucucacaguguucccaggcuggacucaaacucuuggugcucaagcaagcgauccucucaacucagcuuccugaauagcugugacuacaagcgugggccacugugccaggcuugauuuuccaaauugcauuuucaaaaaaucuccucccauauuugggauagaagacauccaggugguucauacucauuuaccagggcugucuuaagacuuuuuaaugcaauaaaacauauuuuuaacuacacacuuaguucuuucauuuacuccugaacuaauguuaauuucuacuuggaaaaugaaaagguuauuuacuuuuuuuuuccugaaaugcugacaauaugugauaucuuaauaucuguaauucuuagugaaaguuaugguauaguauaggugaagcuguaguguuuauaucaauagaugugaauucaaaugagcaaucuaauaauuauuuacuauucaauuauguuaauuuucuucucuuugucucccauuguuucugcagaggcaguuggugucaccagccagcgaccaguguuuuguccuuuucauaaaaaggagcagcugaagcuguacugugagacaugugacaaacugacaugucgagacugucaguuguuagaacauaaagagcauagguaccagcaucuuugguuauauauauagauucauaugcagcuuuagaggacuaaaggacugcugccaacccucaucaaauggcagucugcaaauagguuuuguuuggccagcacuaugcuggccuguacugggguuugucacuuuugacacuauugauguuuugggcuagguaauucuuuauuguugaggacugaucugugcauuauaugguggucagcauccuugaccucuaccaacuaguuaccaguagcaacccucuaacccuccccaguugugacaacaaaauguggcuccagacauuggcaacguccuauggagcaaaaucauccugaguugagaacacuggccaacacacuguuuuaaaauauauagaacuaguugccagcauuguaaaauggggagauuuuacauuuuuuaaauaucuagauuucuggcuuuuuugagaaaacggaagcuguucuagcccugggucuguauacuucaugucaacauuugaggcaugccuuuuccaguucauuauaguuccuagcaaagcucacuuuuaaaucugaucucaacagucauucaaaggucagcaacagaugauuuagacaguaagauucggauugauacaaauauaauugcuuaugauggucuaggcucccgauaauggcagacuagauaauuuggaucaacagugagaaugacuagaaaaccugcacaaaauacagaaauugucuauaugaaaugcuagagcaaauaguaaagcauuauuggacaggauuggguuggaguuggggcuaagaauggugggggccuuuuucuccccuugagguauuugcccagagauugaggaguaauuuugauaggcucacagggcugagaaaucacagcuuagagugcaaggaucaugcauggugaaugugucuccuugucuugaguugggacccugaaagucugcacuauuauaguaaagauaaauuagcuaguaaguuguuccucacagggacuaaagcucagcaacuaaaauuggauuaaagugaaaucauaucgcuggcuccucaaguuuccuuguagaaucaaauguaaauccuugcuagaaagaaaaagaaaacaucuaggccuccaacuuauucaauaaugaauuuugcaaaaacaguauucacagaauuagaaauaaccagguuuguuaggagauuagacaaugcgaacauagugagaccccauccccacaaaaaauuagcugggcaaaguggugugugcuuguauuccuagcuacuugggagacugaggugggaggauugcuugagcccaggaguucaagggugcagugauagugccacugcacuccagccuaagugacagaaugagacccugucuuuaaaaaagaaagaaagaaaacccuaaaaauuacaguaacugaaauuaacucaguagaagggcuuaagaacagauuuggccuagcaugaaacgagaauuaaugagcuagaagaaaauuaagaaaauauccagaaagaagcaucaucagcaagaggaggaugaaaaguagaagagauuaaacaucuaauguggauguaauugcaguccaagaaggauggaaaguacagagaaugggaaggaagcaauacucgaagacagaauguaauggcugagaacuuucagaagcugacgaaaggcauucagcccauauuuaagaaguugcacaaaccucuagcaggauaauuaagaaaguaauauuuuuaaagugcaaaaagaaaguaacuuucaaaucuaaaauucuguaccugguaagcauauucuuuaaauaugaaggugguugaaaaacguuucaggcaaaauaaacugggagagcauaucccugcuaaacucucauuuaaaguaccucuuaguagaagaaaaauaauaggagauacagaaaggaaaauggagcaauagguaugaguaaaucuaaaugaauguugacuuaggaaacaauaauaucuuguugauguggugugcguauauguauaucacauagcagcaaauguacuaaaaggguauggaauuuauguucuaagguccaugcauagucuaggaagagggugaaaaguaccaauauuagaugauauguaaaaaucuguucuuguaaugucuagaguagucacuaaaagaauaauaaguacauauaauuaccaagguguggagaguuguggggauguggaauaguuaaucaguauaaacaaaggccaaaaaaaugagaaaaagaaauaaagaacagauggaauauaaugagaccuugguaaguugguagaucuacaaauauacuauaauuauacuaagugugaacagacaaaauguuccaaauuacaagacagguuucggacuggauaagaaggaaaauagaaaaaugugcuauuuucuuuuuaugagaaauaucuaaaaacucaauguauaaaauacuuaaugggaaaagacacaccauauaaauauuaaccaaaggcaagaugguauaguagacaaaauccauuauuugagguaaagagggacacuuuguaaggaugaaagucucucuucaucugaaagauaugaguuguaaauuuauacagguuauaaacuuacaaaaaaaugacagaauuucaaacuaauagaaaacuccauagucacaguggaaaaucuuaccacuuuaugcaauaauugaagccgagcaguguggcaggugccuguaagugcuagcuaccuagcuacucgggaaacugagaaaucacaggugggaggauggcugaagcccaggaguuugaguucagccugggcagcauagcaagaccuaucucuaaaaaauaaguaaguaaguaaauaaauaaauaacaaaacaagcagacuaaaaaaucaguaaagauagagaaauaagggccaggugcaguggcucacaccuguaaucccagcuacucgggaggcuuaggcaggagaaucacucgaacccaggagguggagguugcagugagcugagauggcaccauugcacccuggccgaggcgacaacagcaaaacuccaucucaaaaaaaaaaaagauaaauaagauugaauaccacaauuaacauaacgucuuauggacauuguggaacacuguaccccaaaauauacauucuuacaauaaaauauuuuuaacugaccauaugcuaaagucuuaaauuugaaaauauugaaaaauaccauauauuuggaaaugaaauucuugugauaacuaaagucuacugauacacaauccuggaauucuagauuaaaggaaaaaauuauuuagaagacauuauugagacaaaugauauaauuaagaaacauggucuauaguuuaaaguacuguaaacaaagucauuuuuuuuuuaacuguacuaugggcacauaagaaaauccuuuuuuuuaggaaaugcacacugaauuauuaagggguugaagggcuaugaggaggcaaacuaaaaauugauuaaucuguauaaggagauauaugaucucuauauacuugcaaauuuaacuuugaaauuguuuuaaaauaaacaguuuaauacauucaaaucaucaagaagaaauuccaguagaugguagaaaacauuuucaucugaaugauagugaaaaacaucagucaaucaagccuugagguuuuucuuuuuaauaacugaagccauauuuggaggacaauuuauauuauuaaaugcauauguuauauguugaggauaaagucaauucacuaaacauuuauugcaguuuagggaaaguagguaauuaaacccaaaguaaguggguuuuaaaagaaacauaauaaagacaaguguagaaauagucaaagccaaaaauucagucuuucaaaagacuaguaaauaaucaacaauucucuguaugagugauugagagagcaggcccaaauaaccacuaccaggaguaggaagguggcauuacuccauauuucaaaugcauuuucaaagauaaaaaggauaucugucaauaauaaugaaaauuuuuacaugauauuggaaaacuuagagaaugaagcuuuuuaacaaaacuuuugcuaaauacaauagaaagucagaauagucuuuuaauguucauucauaauuuaaaaccuucccacaaagaaaauuacacaugcaaaugacacagaugaauguaccauauaguuaaggcaaaaauagccccuuuuggccgggcgagguggcucacgccuguaaucccagcaccuggggaggccgaggcgggcggaucacaaggucaggagauugagaccauccuggcuaacauggugaaaccccgucucuacuaaacauacaaaaaauuagccaggcguggugguggguauagucccagcuacucgggaggcugaggcaggagaauggcgugaacccaggaggcagagcuuccagugagccgagauggggccacugcacuccagccugggcgacagagcgagacuccgucucaaaaaaaaaaaaaaaaaaaaagccccuuucuuauacaaacuugucuggagaauggcaaaaaaaugaauucuuuccaacuuguuauaugaagccagcauaaccuuuacaccaaaacugacaaggaauagaaauggaaaauuacaggccagucucacucaugaaaugaauguaaaaauuccaagaaacggaaaauaaguaggaaacagaugauuugagaggaggggaaaacuugccuuaaaucucguaguauugucauuuugggacaguguaaucacaaccaauuuggccucaucuuagggauacagaauucauuuaacaugccaaaaucauugaugcuaaaaucuugcaugucauauuaaaagaauaaaggaaaaaguauaugccuaucucaauagaagcaguagaaacauuccauaaaaauuaaauauacauucaugauacaacaucuuagcaaacuagaaauaaaaaagaacuuccuaaaccugauaaagauuauuuauggaaagcagaaaacguacuuaauauuggaauauugaaagucuuugcauugagauuaggaacaacauaagggugaccauuuugaccauuucauguaaccuuauauuaaauaaggguaguaaagaaaaaguuuacuaagguaaaaaaaacuugaguugccuauaaaaguauuugaaauguuauaauucacagauaugauuauauacuaaggaaauccaauguaauuauuaacuggguauccccuuuuucuaacuggcaacccuauuuaguuacauguaaacauuuaaaaucacauuauauaaaauuguuaauuuagaaauacuguauuuuguacauuuuauagaaaaacuuaaauaaaauucuuguuauguaucuucuauaucguugccuuucuaucuucucuagaacuucucuugaguuaucaaacauagucuggcaaaguaaaucaucuuuccucaguuucaaauuggaaacuuuuuaaagugcuguaucucauuauacuguugcuuaaaaguuuuauuacaaggcauaacaucaagaauuuugcccuucucugucuguauuuauccugauuuaucuuguggccccuagaacauaacuaccuauuauuuaaaaguggucuuuuaaaauguuuauuuucagcaggcuugcauaauguagaaauuacaaaauaguuaauaaaucugauuauguauaauugacuauuuuuugccaaguccaccaagugaaagugaacucuguaagcuuauaaaaacugaaugauggaugcaugugguucucaaacuuucaaaauauuuauguguccauaaucuuucuugagggauaauuugagaggugagggaaacuugccuuauuagggauacguuugauguuuuaaaagauuauuauauaaauucuuuauaauccuauuuuauguuuuuaugucuuuuuuuauucuuggacuuuuuccucauuguauauuuuuauaugaaauaauuugcuuauuucuucagauaccaauuuauagaagaagcuuuucagaaucagaaagugaucauagauacacuaaucaccaaacugauggaaaaaacaaaauacauaaaauucacaggaaaucagauccaaaacagguaauuuuaugguauuauguaaucauuuuuauauaauuuguuaaguauauucacuuuuagaacauuuuccuuaagucacaguuaaguaauacguuguuagaugacugcaauaacacaugacugauaagacuuucccagaaacuuaguuggaaagcauucuuuucugcuguaaaauuucaaaacuaauaauaaacuacacuuaguauuuuaauagcucauuuaucuaauagguauugauaacuuauuaucacuuauuuuccaauuuuaaagaaauaccaaaauuuaaaugccaaaucaaccauuuuuuugccaguauuguaaaauauuuuaacacuugaauaaacccuuaauuguuauuuuaagguuugcugaaauuugagaugccugccuuaugcugcaauuuuuuuaaaacugcaaacagguggaaauuuuaagacacuaggauacagggauuguuaaacuguuccgcacacuuuuuacuucuugucugauaaaaugcuuacuuacacaauuacuuguuaugccuuuugcccugguaagaaaaucaucaacuguccaaagucuuagacaucagugauuagggagaaccacuaaccuccauggagcgggggcagcuggagguguugucuaaccccuuuuuaaaaucccauuuagggcacauacugacauuuaauuuacacaccuaugaaaucccaugaccucuucuguuguuuuacacacaaaagaaaugucacugccuaaauaagucaagaaauguuuauuagaaugagccagcguaaaagagaccucacagagaauuuaaauguuuuucuauguauaaauugugucagacuuuaaggcagucaucacaaucuauuauuaucauuuuggaacauagcuggggguggagcauuugggaauuuuuuuaagguaauuaaaucccuguauuaccugauucccuuaaaagagauuuuuacacauaguuuuaccauuucuugaugccccagcaucauucuuauaucuguuuauuauuaugcauuauguuguguaucuuuuaguuuuucuuguuaucagcucucauuuguuuuuaccucuguuuuuguuuuuuguuuuuuguuuuuuuuugagacggagucucacucugucacuuaagcuggagugcaguggugugaucucagcucacugcaaccucugccuccuggguagcugggauuacaggugcccaccacugugcccagcuaguuuuuguaucuuuaguagagaugggcuuucaccauguuggccagccuggucuugaacuagugaccucaggugaucugccaccucagccucccaaagcacugggauuacaggcgugagccaccauaccuggcccuguuuuuacuuuucucuuugacacaacuauaguuaaugaaauacuauuuucuuuauuuaccauauucuaaucagaauaguauauuuugccaaguagaauaauugguggguuuaaacuuuuuuuauucugaguaauugaaaauuuguaaugaauauuuauugaaugaaugaagagagauaauuauaggcauuucuaccaucuaguggcaaaagguagcaaucauaaaauaauuaauuuuaaauuaaacaucugcccuuaaugaaauuuaucccuuugacuuuuuucuuacuguuucacugaguauaugguuugauuuauggucaaaguuuacauuuuuuuuuauguaccgcugucaauuuuuuccacuaucauuuguugaaaaaacuuucuguugaauuguuuuucagcaccuuuauagaccauauauaugugugggauuauucuguuccauuguguuuuucucauugcuaguacuucacuuucaugaucaugaucauuguaguuuuuuauaguaagucuuaacauaguguuuuucaaauuucuucuuuuauuuuuauaaaugauuugugcuuuuuuucuucuacaaaauaauaacauuguguguaacaauuuugauuucugaauugaggcaaaaaauuaaacaaucuuuguuaagugcaaauugcuuacauaucuuuauagccuaugugauuauaaaaggguacauuuauuagaguaacugguagucauuuuuaugcauuugaccccauggcacuguuuuucccuuacucauccuauucuaccaucaugaauauuuaaaugacuuuuuugagauugguugcuucucaggcuuaucugguucccuugauccuguaguaauguugaugucaaacaauuaucuggaagaauuuccagcaggaaauaaagucucugccaguuuggucuugaguuuuggaggguaacuaugggagaagcuuacagaagaaaugaagcuuuuaauuuaaucucacaaaguuugguggaugcucuguuauuuucuauaagauauucuggugugguaccguauguuuuucuuucuguaagaguguugcuggaaucaggagacuggagagaccaguaggugaaacaggaggauuuuauugagugcacucauacccagcggauuaauauccaaagaccaggccuagaacaaagacugggccuagaacaaaggcugggccuagaacaaagacuggacuuggcuuuuauacacacuucuaaaaggggaugggcuaguuugaaacaagcuuacaguggcgugaagcauaguggugugaaagcucagguacagaagcagaacaaaggcaguuaaucauacuuugacagguucauaacucaggcuuacaaugacucuugcuaugcggccuagauggcuguuaucuaggcuugcucuagugccuugugcuggcuuaucucauaaccuucacuauggugucuagauggcuacaauccaggcccgcccaggcaugucucaugacuuucacugagcugcuuagauaaaacaaugcuugaaguuacuaguuauagaaaacaagaaucuauaaacucauaaguuuacucauaccauaggagaaagaaaaauaaagaaaauuuguuuuuuucuucuccccauguugggggagugcugggagagucuucagagcacauuccuuugagcccuagcuucuuagauaauauuaucaagacuuuccugggucugggcugugccuguuucugccucugggauaagucagccuaauacaugaaagcuuguuuuucaaacuugcuuuucucuuuuuaauuuuauuuuucuuuuuuuuucuuuaauuucccaccucaagagaaguaugugguugauaaaacauaguuauuuggcugcuaauuuugcaaagaauggguuaaguagcaaacuacuauuuuugucuuuuucuauuuagguguaugaauacuguagcaguuaagaauacuaagaaaagagugucacauauacacuuuucuagcuuucgguugcaauuaauauaguagaacauguucagaaucaucaugguuuauaaauccuuuuugguccacccccacccccccccccauccuuuuagguagagcauugauuuuccuggguguucucauaauuuuuccaaaccauauuuucuuaaaauguacucauucucuucuaauuuuauauauauuuuuaagauucaagacuuaauuuuaagauugaguggugauaucuuucagaagaauuauauuucugcugucucaucuucaagacagucaauuuaaagugaaggacucagaaauagagcuucuaagggcugaaaacauuuuggucuaauuuagacauuaaaacgucaauuuuaaauauuauacaaaaaaacugccuuauguuuuuccccguuuuaauuuucagaauuauugaaguaaaucaaaaucaaaagcagguggaacaggauauuaaaguugcuauauuuacacugaugguagaaauaaauaaaaaaggaaaagcucuacugcaucaguuagagguaagugacugcccaugggauaguauauugauucaacauaguauuuccuaaaguacugugaaguagaaaucauagugcuuuuuauauaguuguuucauugugauuuaauauuuuuuuuucccacucccaaguuuuccuuugcuggguuuuguauuguagcugacaauuuaaagcuuuauaauacgcuaugaaugucugaugacugauuguuuucuuuauagcacaaauuauaaugccuugcuuguaggaggaucucugaauguuaaacagaugaguuauuuucgagaugcacugaaaugaaaauuuugcaucaccaaggugguuuaguggagcagaauuuucuagaaagauacacuguucgauuuaguucucaaauauauauauuuaacccugugagaaguuagguaaaagaauauggcuagcccugcccucaacauuuuguaauuguaauugcgagagcagcacuuagggagauaugcccaaggcacuuaguuguuucucacugcagguaagaaaaacauuaccaucuuccucagcuuuuuaaaacucaugaaggucaagauccaaacuugguguuugacuucaaaucauauaagguuauaacagcuacaugguacauuaauguauaauauuaauugcaugauuuuuagguauucuuuuaguacguugacauagaaagcauauugauacaguaaagaagcaaaugagaaaaaaaagaauccuaauguuugaagauuugaggaaaaauaagacuucuagaaauaauuuaggucauccuuuuuauaucauaauuuaccaaauuaaaagguuucugucagaaaguucuaucccuucugggaaagcauggucauuccuguguauuaucagcuguacaggaaacaaagacuaaaauaauucucuguucuuuuggaaacguaguuauuuagugaggaaguauucugggcaggaacaaucagaccccauuuauaguaacuauuuguucaaggucugugacuuuaaaaaaaaaaaaaaauuuaaguacaauuuuaaguuuccaaaacugcuuaaaaucaaauaucacuuugauuugcuuucccagauauuaguagugcauacauuacuaugucuguguuuucaaacuugacuguacaucagaaucacuugaagagcuuuacaaaggagaugaccagacuugcaaaucuguaggaaugaaccuggucaguauaucuacugaugaccagguucauucuuaaaauuaaaaaaaaauuuuuuuugagacagggucucacucuguugcccagacagaagugcaauagcgugaaucacggcucacuacagccuccaccuccuggucucaggugaucuucucauugcagccucucgaguaauuaggacuacaaguguaugccaccaugccuggcuaauauuuuuuuuuuuuuaagaggggggguuuugacacguuggcucaggcuggucucgaacuacugggcucaggcagucugucugccucagccucccaaaguacugagauuacagguaugagcuacccaccuugcccccccuuuguuuuuuuuggagacaguguuuuacuuuguuguccaagcuugaaugcagugguguuuucacugcagccuugaccucccaggcucaagcaaucuucccaccccagucuccugaguagcugugcaaccacaccugacuaauuuuuuauuuuuguagagaugaagucucacucuagugaauuuucuuauuuuacuuuuuagagacaaggucucacucugucacccaggcucgaguguagugguauagccuuggcucacugcagccucaaacuccugggaaacugggacuacaagcgauccuccugacugagaagcugggacuacagggcgugugcugccacuccuggcuaauuuauuauuauuauuauuauacuuuaaguucuaggguacaugugcacaacgugcacauauguauauguauacauguauacauguauacguguauguuacauacguauacauguuacacguuacauguuacauauguuacauauguuuacauguguuacauauguauacaugugccauguucgugugcugcacccauuaacucguuauuuacauuagguauaucucccaaugcuaucccuccccccucccccaaccccacaacaggccccggugugugaugcuccccuuccuguguccaaguguucucauuguucaauucccaccuaugaaugagaacaugcgguguuugguuuuuugucccugcgauaguuugcugagaaugaugguuuccaguuucauccaugucucuacaaaggacaugaacucaucauuuuuuauggcugcauaguauuccaugguguauaugugccacauuuucuuaauccagucuaucauuguuggacauuuggguugguuccaaguuugugcuauugugaauagugccguaauaaacauacgugugcaugugucuuuauagcagcaugauuuauaauccuuuggguauauacccaguaauggaauggcugggucaaaugguauuucuaguucuagauccuugaggaaucgccacgcugucuuccacagugguugaacuaguuuacagucucaccaacaguguaaaaguguuccuauuucuccacaucuucuccagcaccuguuguuuccugacuuuuuaaugauggccauucuaacuggugugagcugguaucucauugugguuuugauuugcauuucucugauggccagugaugaugagcaauuuuucaugugucuguuggcugcauaaaugucuuuagagaagugucuguucauauccuuugcccacuuuuugaugggguuguuuguuuuuuucuuguaaauuuguuugaguucauuguagauucuggauauuagcccuuugucagaugaguagauugcaaaacuuuuuucccauucuguagguugccuguucacucugaugguaguuucuuuugcuguguagaagcucuuuaguuuaauuagaucccauuugucaauuuuggcuuuuguugccauugcuuuugguguuuuagacaugaaguccuugcccaugccuauuuccugaaugguauugccuagguuuucuucuaggguuuuuaugguuuuaggucuaacauuuaagucuuuaauccaucuugaauuaauuuuuguaucagguguaaggaagggauccaguuucagcuuucuacauauggcuagccaguuuucccagcaccauuuauugaauagggaauccuuuccccauugcuuguuuuugucagguuugucaaagaucagaugguuguagaugugugcuauuucugagggcucuguucuguuccaaaggucuauaucucuguuuugguaccaguaccaugcuguuuugguuacuguagccuuguaguaaaguuugaagucagguagugugaugucuccagcuuuguucuuuugacuuaggauugucuuggcaaugcgggcucuuuuuugguuccauaugaacuugaaaauaguuuucuccaauucugugaagaaagucauugguagcucaacggggauggcauugaaucuauaaauuaccuugggcaguauggccauuuucacaauauugauucuuccuauccaugagcauggaauguucuuccauuuguuuguguccucuuuuauuuuguugagcagugguuuguaguucuccaugaagggguccuucacaucccuuguaagugggauuccuagguauuuuauucucuucgaagcaauugugaaugggaguucacucaugauuuggcucucuguuugucuguuauugguguauaagaaugcuugugauuuuugcacauugauuuuguauccugagacuuugcugaaguugcuuaucagcuuaaggagauuuuggacugagacaaugggguuuucuaaauauacaaucaugucaucugcaaacagggacaauuugacuuccucuuuuccuaauugaauacacuuuauuucuuucucuugccugauugcccuggccagaacuuccagcacuauguugaauaguaggaguggugagagagggcaucccugucuugugccaguuuucaaagggaaugcuuccaguuuuugcccauucaguaugauauugacuguggguuugucauaaauagcucuuauuauuuugagauacgucccaucaauaccuaauuuauugaguuuuuagcaugaagggcuguugaauuuugucaaaggccuuuccugcaucuauugagauaaucauguaguuuuugucuuugguucuguuuauaugcuggauuacauuuauugauuugcauguguugaaccagccuugcaucccagggaugaagcccacuugaucauggugaauaagcuuuuugaugugcugcuggauucgauuugccaguauuuuauugaggauucuuacaucaauguucaucagggauauuggucuaaaauucucuuuuuuuguugugucucugccaggcuuugguaucaggaugaugcuggccucauaaaaugaguuagggaggauucccuguuuuucuauucguuggaauaguuucagaaggaaugguaccagcuccuccuuguaccucugguagaauuuggcugagaauccaucugguccuagacuuuuuuugguugguaggcuauuaauuauugccucaauuucagagccuguuauuggucuauucagggauucaacuucuuccugguuuagucuuggguggguguauaugucgaggaauuuauccauuucuucuaaauuuucuaguuuauuugcauagagguguuuauaguauucucugaugguaguuuguauuucugugggaucgguggugauauccccuuuaacauuuuuuauugcgucuguuugauuguucucuguuuucuucuuuauuagucuugcuagcggucuauuuuguugaucuuuucaaaaaaaccagcuccuggauucaucaauuuuuuugaaggguuuuuugugucucuaucuccuucaguucugcucugaucuuaguuauuucuugccuucugcuagcuuuugaauuuguuugcucuugcuucucuaguucuuuuaauugugauguuagggugucaauuuuagaucuuuccugcuuucucuugugggcauuuagugcuauaaauuucccucuacacauugcuuuaaaugugucccagagauccagguacguugugucuuuguucuuauugguugcaaagaacaucuuuauuucugccuucauuuuguuauguacccaguagucauucaggagcagguuguucaguuuccauguaguugagcgguuuugagugaguuucuuaauccugaguucuaguuugauugcacuguagucugacagacaguuuguuauaauuucuguucuuuuacauuugcugaggagugcauuacuuccaacuguguggucaauuuuggaauaagugugauguggugcugagaagaauguauauucuguugauuugggguggagaguucuguagauaucuauuaggucugcuuggugaagagcugaguucaauuccuggauauccuuguuaacuuucugucuuguugaucugucugauguugacagugggguguuaaagucucccauuauuauugucugggagucuaaagucucuuuguaggucucuaaggacuugcuuuaugaaucugggugcuccuguauugggugcauauauguuuagguuaguuagcucuucuuguugaauugaucccuuuaccauuauguaauggccuucuuugucucuuuugauguuuguugguuuaaagucuguuuuaucagagacuaggauugccaccccugccuuuuuuuguuuuccauuugcuugguagaucuuccuccaucccuuuauuuugagcuuaugugugucucugcauaugagaugggucuccugaauacaggacacugaugggucuugacucuugauccaauuugucagucuguguguuuuaauuggagcauuuagcccauuuacauuuaagguuaauauuguuaugugugaauuugauccugucauugugauguuagcugguuauuuugcccuuuaguugaugcaguuucuuccuagcaucaguggucuuuaugauuuggcauguuuuugcaguggcuggucucaguuguuccuuuccauguuuagugcuuccuucaggagcucugguauggcaggccugguggugacaaaaucucucagccuuugcuugucuauaacggauuuuauuuuuccuucacuuaugaagcuuaguuuggcuagauaugaaauucuggguugaaaauucuuuucuuuaaggcuguugaauauuggccccuacucucuucugucuuguagaguuucugccgagagauccacuguuagucugaugggcuucccuuuguggguaaaccgaucuuucucucuggcugcccuuaacauuuuuuccuucauuucaacuuuggugaaucugauaauuaugugucuuggaguugcucuucucaaggaguaucuuuguggcauucuccguauuuccugaauuugaauguuggccugccuugcuagguuggcgaaguucuccuggauaauaaccugcagagcauuuuccaccuugguuccauucuccccgucacuuucagguacaccaaucagacauagauuuggucuuuucacauagucccauauuucuugguggcuuuguucguuucuuuuuacucuuuuuucucuaaacuucucuucuugcuucguuucauucauuugaucuucaaucacugauacccuuucuuccaguugauugaaucagguacugaagcuugugcauucgucacguacuucuugugccaugguuuucagcuccaucgggucauuuuaggacuucucuacacugguuauucuaguuagccauucaucuaaucuuuuuucaagguuuuuagcuucuuugcaauggguucaaacuuccuccuuuagcucggaggaguuucaucgucuaaagccuucuucucucaacucaucaaggucauucucuguccagcuuuguuccguugcugucuaggagcugcguuccuuuggagggggagaggcgcucugauuuuuagaauuuucagcuuuucugcucuguuuuuuccccaucuuugugguuuuaucuaccuuuggucuuugaugauggugauguacagaugggguuuugguguggauguccuuucuguuuguuaguuuucuuucuaccagucaggacccucagcugcaggucuguuggaguuugguggagguccacuccagacccuguuugccuggguaucagcauuggaggcugcagagcagcgaauauugcugaacagcaaauguugcugccugaucguuccucuggaagcuuugucccagagggguacccggcugugugaggugucagucugccccuacugggggugccucccaauuaggcuacuuggggguuagggacccacuugaggagguagucuguccguucugagaucucaaacuccgugcuaggagaaccacuacucucuucaaagcugucagacagggacauuuaagucugcagagguuucugcugccuuuuguuuggcuaugcccugcccccagagguggcgucugcagaggcacgcaggccuccuugagcugcagcgggcuccacccaguucgagcuuccuggccgcuuuguuuaccuacucaagccucagcaauggugggcgccccuuccccagccucgcugccgccuugcaguucgaucucagacugcugugcuagcaaugagcgaggcuccguggguaugggacacuccgagacagacguggguuauaaucuccuggugugcuguuugcuaaguccguuggaaaagcucaguauuagggugggagugacucgauuuuccaggugccgucugucacagcuucccuugguuaggaaagggaauucccugacgccuugugcuucccgggugaggcgauaccuugcccugcuucggcucacacucggugcacuguacccacgguccugcacccacuguccgacaagccccagugacaugaacccgguaccucaguuggaaaugcagaaaucacccaucuucugcgucacucacgcugggagcuguagacuggagcuguucuuauucggccaucuuggaaccacuccuccgccaccccuguuuguuuuuuuuuuuuuuuuuuuuuuuuuuuuuguaaagacguggucucacuauguugcccaggcugguuggaguccuuuuuuaaaggcaaauaaaaauaaccccuuuuaucuguuaagacucauaagaaauuggcugaaauagauauuaggauagaggaccaaaaauccagggcuucugauucuuaauucucaaccuucuccaaaguaaacaauuucuauuccuacuagaauguuuccaaagaaacacuuaauaaauuuuuacagaggucaaaaauagucuacuaggcaaauuacugucucucugaacuuaaauuagauauggcagagccguuggauguuguuaguaguccaucaaacagacaacuaccauuuccuccuuaauucaauguagcucaaguguauuuuccaaaucuggaacugacuagggcuaggaucuggguucgcuuuuuauugagaauguaaguccauguuguaguauagcaauuuuacuuguaaacauuucuaauuugucugagacagcagaaaguccuguuuuccuccuuuuuccuugcuaggucuaggaugagguuuuugguuaggaaccuuuaaaauaacccaaguucagugugcucuacuuuugauuauccaucuucucuaaggaaagcacauacauaccuccuuuagagaaaucuauauucuuuuauguagcuuuuguuagagugcauuggcccacucauucagugcaucuguuggcuccgauguuaauucucaauagacaaauaauaugaugccuuuuaagaaaauuaccacauacaaaggguaagugucaucuacaacacagcaugacucuguuuugcacaaacuacuugcaauuccaacuguuaaauagaaucccuaaaaggugaaaucauaugauugaguaaauuaugugauagaguuacuuuauagguuugcuggacaguacaucuguuuuauuugugaauguugaauuucauagacauuuacuguacuauagcuaaucuuuccuuuuuuguguauuguaacaugcaugaacagaguuaaaucccagaauauguaaaaccugauccagggccuugaggagugaggggccacauugggaugcaguuuuuugccauagugaaagugauccuuuauacuaauagggaaaacagaguauuuuuaguuucaguaaauugaguaauuagagauuguaguuauucuaauuuguuuaccuggaaaugaccaucaaagucuauguuacaugcugauacuaauuuugaaacuauuuucuuguuuucagagccuugcaaaggaccaucgcaugaaacuuaugcaacaacaacaggaaguggcuggacucucuaaacaauuggagcaugucaugcauuuuucuaaaugggcaguuuccaguggcagcaguacagcauuacuuuauagcaaacgacugguaagauaaaguaugcuauuuaauauacuguaaaaaugcacaguaaaacaauggagccauuguaaugcuuaaaauuuauucugcuugugcaucagugcuuuuuaccuauuucuaauaucuaucaaaauauuuugguuuuaauauuuuuaccuggcauaauuuggguguaauuucaguuuuaauuuaucauuaauuccuuuuuuuguucuuuccaaguauucacugucuucauagcaauugaaguuaauaucaaaaauaaggaugauagugaacauuuucugauuaucuauagugugccagguacuaauucuaagaauuuccauguaauauuuaaacuuuuaccucauucuuaugagauauaccuauucaccccccuuguacacaugaugaaacuaaggcaugugauuauguaacaugucuaacaucacacaauaugagguauagccaggguuuauaauaugaucucagacaugaccugagccuguguucuucuucuuggugcugcacggcaaucuguagugcuggauauuuuugccacagaaaaauagcucugugauuuggugaacuauuugacauuggucuagaaccuuacuacuucacauaugacuaccacaucacuugaggauucuggucaggagaucugggguggggcuugugaauuucuaacaagccuucaggugacucugaugcugcuuggucugugggcugugcuuugaguaacaaagauauagaagacauuuagcuacauucuuaaaaauuccugcuuuacauuaaucuuauuaaagauucaacagagauuuauacuccgaaguauacuauaaaccauagguucaguuccagacuaucgcaguaaagcaaauaucauaauaagccaagccauacaguuuuuuuaaguuuuccagugcauauaaaaguuuugauuauaaauacuguaguguaacugugcaguaguauuauguuuuuuaaaaaaacaguguauauaccucaauuaaguaaucuuuuuuuuuuuuuuuuugagacagagucucacucugucgcccaggcuggagugcaguggcgugaucuccacucacugcaagcuccaccucgccgguucacaccauucuucugccucagccucccgaguagcuggaacuacaggcguccgccaccaggccuggcuaauuuuuuguauuuuuaguagagacgggguuucaccauguuagccaggauggucccgaucuccugagcuugugauccacccgccuucgccucccaaaguucugggauuacaggcgugaaccacugcacccagcuuaaagaauacuuuauugccaaaaauguuaaucaucugagccuucaagagucauaaucuuuuugcugguggagauguugauggccacugggguuguaguugcugaagguugggauagcugugucaauaucuuaaaauaagaugacaaugaaguuugcauugauugacucuuuuuuaguggaagauuucuccguagcauacaaugauaauuugauaguauuuuaccuacaauagaacuucuuucagaauuggagucaguccucucaaagccaguagcugcgguaucaccuaaguuuauggaauauucuaaauucuuuguugucaucucaacaaugaucacagcaucuucaccaggaguaauuucuaucucaaaaaaccacuuuucugugcucauccauaagaagcaacuauucauccauucaaguuugaucauaggauugcagcaauucagucacaucuuuaggcucuacuuauuauuccaguucucuugcuguuucuaccacaucuguaauuccuucuucacugaagucuugaacuccuccaggucaucccuaaagguuggaaucaacuuauuccuaacuccuguuauuguugauauuuuugucuccucccaugaaucacuaagguucuuaauggcaucuagaauaaugaauccuuucuagaagguuuuuaauuuacuuugcccagauccaucagaggaaucacuguguaugguggcuauuauacuagccuuauguaacguauuucuuuuuuguuuuugagauggagucucacucuguugccuaggcuggagugcaguggugugaucuuagcucacugcaaccucuagcucccagguucaagcaauucuccugccucagccucccaauagcugggacuguaggcaugcgccaccauguccagcuaauuuuucuauuuuuuauaagagaugggguuucccuauguuuuccaggcuggucucgaaacuccugaccucaagugauccacccgccuuggccucccaaagugcugggauuacagcaugaaccacugcacccagccgcauaauguauuucuuaauaauuauuucuuaaauaauacuugaggccaugcaccuauaauacaacacugagaggcugaggcaggaggcucacuugaggcuuggaguucgagaccacccugcgccacagggugagacccugucgcuaccaaaaggagaaaaaaaaagacaugagaaucagaauuacuucuugauucaugggcugcagaauggauguuguguuagcgggcaugaaaacaaccuuaaucucauauauuuccaugagagcucuugggugaccaguuguauuugucaaugagcaguaauauuuuaaaauccuuuauuuucugagcagugggucucaaaagugggcuuaaaauaauaacuaaaauauauuguaaguagaugugcuguaaucccggcuuuguuuucacuuauagaacacaaaagcagcguagauuuaggauaauucuugagggcccuaggauauuuggaauggucaaugagcauuggcuucaauuucaagucaucagcuacauuagucccuaacgagagucagucuguccuuugaggauuugaagccaugcauugucuucucucuaugaaauuucuagauggcaucaucuuccaauagaagucugugucaucuacguugaaauguguuguuuagcauagccaccuucgucaaugaucuuagcuguaucuuuugauuaacuugcugcagcuucuacauuagcacuuggugcuucaccuuguacuuuuauauuguguauacugcagaauggaugguuucuuuccauaaaucucauggaccaaccucugccaccuuaaaacuuucuuuugcagcuuccucaccucucacagccuucauugaauuaaaaagaguuuuaggaccuuucucugaauuagaucuuggguuaagguuauguuauagcuggcuugaucuucuaucaagaccacaaaacuuucuuccuaucagcaauaagucugcuuggcauucucuucauucauguguucacuggaguaacacuuucgauuuccuucaagaacuuuuccuuuacauucacaacuuggcuaacuggugugagaggccuagcuuucagccugucucagcuuuggaccugccuuccucaguaagcuuacucauuucuaacuuuugauuagugagagucaugcaacucuuccuuucacuugaacacuuagagacuauuguaggguuauuaaauuguugugucugagacuacggaggccugaggagaggaagaaagaauggcuaaauugguggcacaaacagaauauacuauuuauguuugcucuuacaugggugugguuuguggugucccaaaacagucacaauauuaacaugaaagaccacaaucacuauaacagauuauuguuaagaauuaccaaaaugugacagagacacgugagcaugugcuugcuguuggaagaauggugcugauuuucucaaugugguguugucacaaaccuuaaauuuguaaaauuuacaguacuuacgaagcgcaguaaagcaaagcucaguaaaaugagguaugcuuguauuacuaccucuaaaugaaguuuucugucaccuauuccaaaaaauggaaguccagaaauuuucuauacaauuuuaaaauaaggaaaugugauucuggauaaacuuuauaaaguaacuucaaauauugagugacaucagaguucuauaacuuuucuuaaucaugaauuguauuuaauucuuaggauuuguuuuccuuucauaauuaucagugcuauagucuccauccugagucuuauuuuuucauuaguuuuaauggaaaacaucuauacacuauauaccuucuguauucuguuacuuacauuuuuuugaaagucaaauagaaaagggauagagggaauagagaauuguguuuuucaacuuaauccaucaugaguauguauguguaagacacauucaugcaaucagauaagcauuccgucaaucuccuuaucaauuuaaaaauguguuuuucauuguguucugauuuuguuugauuguauuauggagaaaauaaaaauagaugggauaaauuaauuuacacaaugaacuguugaaauaggaaugaaagagauagucaucuauaugauacauagaagaaaauaggagcagugaaucauauaguaccaguauuaccauauucuugguuaacuaaauuuuaaaauccuguggaacccaagugagcacugaugcauuucuaguagcagcuguagauaauaauuugccuguaaugcaugcagagcugagguucaugauuauuuuuaaacauuuagaagauuuucuaacuucagaaaaugugaaaaucauuauauuguauaacucuguucuccagaguucugcuuuauaaauauagccauguuuacucagguuauccuuuaagugauggauuuuaugugcuuaaaaaauggaaacgaaaugccuagcagcccugaaaccucaagcuuggcuugcuauuuuaaaaaauuuauuuauauuuuacuauauauuuaaaguguacaacaugauauucugacauauaugcauauugaaauuauuguuucagucaaacagaugaauauccauuauccuacuuaccuuguaucuauguguaugguaagaacaccuaaaauccauaacauuuuugauauacauaacaguguuauuauggagguuuuuuugguuuauucuuuugguuuucuguuuuuuuuguuguuguuguuugaaacagggucucccucuaucgccuaggcuagagugcagugacaugaugauagcucccugcagccucaaacuuguaggcucaagcgagccuuuugccucaguuccccaaguagcugggacuacaggugcaugccaccauaguccagauuuuuuuuuuuguagagacaaggucuuguucugucaccccagcugucuugaacuacaggugugagccaccacaucuggcuggcauuacaguguuauuaacuguaguucuuacucuguacauuaaaucucaaugcuuauucauucuaccuaccuggaaauuuguacccuuugacuucucuacauuuccuacccaccuagccccuaguaaccaccauuccaguuugucuucaacuuucuaaaaauauuccauguauaagugagauuauacaguauuuucauuucuggaucuggcuuauuucacuuaccauaguguccucaagguucauccuuguuaucacaaauagcaggauuucuuuccuuuuuuaagguuggauaauauucuauuguauauaucuacugcaauuuauuuguccaugcaucauuggauacagguuguuuuucuaucuuggccauugugaauaaugcugcaaugacaugggaguguagauaucucuacaagguccuauuucauuuccuguuguaauauacccagcagagggauugcuggaccuacaguaguucuguuuuuaauuauuugaagaaccuccauaucguuauccguagugguugcaccaaucugcauucccaccuaaaguguacaaaggguuccuuuuauccgcacccuggccaacacuugucuuccuugucuuuuugauauuagcuggauccuaacagguaugagaugauagcucauuguggucuugauuugaauuuuccuauugaucagugauguggaacaucuuuucauaugccuauuggacauuuuuaugucuucuuuggaaaaauauaaauucaaacucuuugcccauuucuuaaucacguuauuuggguuuuugcuauugaguugugugaguuucuuauaccaguugagcaucccaacggaaaucugaaauucuccaaaauucaaaacuuuuugagcaccaucaugacaccacaaaugggaaauuacacacauaagaauugaacacaccuuggauucaugcacaaaauuauuagaaauauuguauaaaauugcuuucaggcuauguguguugaguauaugaaacauaaaugaauuucauguuuagacuuggaccguauccccaagauaucuaauuaucaauauacauaauacauaaaaucugcguguguguguguguguguguguaucuauauauucacauaaaaacuaucaagaaucuuacugucuugccuucucuuccuggcguggaggcaccagcauggugacugaggucacugcacauuggagaggguuggggaaccgcaacaggcaugaagcuggcagccacggaugugaaguggugagggaggaauacggaagugguaagaagaauuagccagugucauuuggauuuugguuacauugaguaaauaaguaaauggauugaauaaguaaguaaauauauugaagguaaucgcagccaaguuuccagagaagguguuuagaaagaaguuaggcuaggaagggcccaaagauguguuggauuggaauuaagaguacaaguaugaacuuagaguuuuauuuuuauucuuggacucagaucuagcaauaauuauagauguauauguccaucuguauguguguauguauucguuguuggugugcugcaucccaauagcagugaggucacuuccuuccagaucuugguuucaaaauaccaaagaaagggggggaaaguaaaaguugugcccagaacauguuguuauaccagaaaacuaccaaaaugcucagagaauaauggggacaugucaaagggaacaggauucaguguaaaagggcucccacugggaaaaccaagaacaaauuugaggaucaaaauaagucacuguaauaauaaauuauaacacacugaauuaaauaagauuacaugaauucauaacauaaaucaguaaacaguagauuauuugggggagaaguugauaacaaaacuaaaaguuauagaaagaacaauggguauacagaagcacauuugaccacuaucauagagauaauuugggaggacuaauuaguggcuguaaauaugcuggguagaggacugauggggaacagaguauuaguagaaucucagaauaccucuucaacuuuaagguuaagaaauugaguagcagaauuauagaucaagauuaauaucaccagugguaugacaaguugacauccuacguuuccuggcacgucaucauuugugugguauucuugccaagaauacuguaacuaagucugaucaggaggaaauaucacccagguuaaaggucauccugcggaauguaaggcauaaaaucuucaaaacacaucagggacaugaacgaaagggaaagacugagcaacugaaaaaugaggcagcuaagcaacuuauauccuugauggcaucauggaaaagacugcugaaacuguuggcauuuggaugaaguguuuaaacuggauggcuguguuguaacaguugguuuaugaauuuggaaucugggauuugguuauguuagaagaucuuuguuuuaggauauccauacugcaguauuuagggaagacaggaccucauuccuguagcuugcucucaaaaguuuuggaaaaagacuaauaacguguguaggagcaguugggugggcacuggagcaaauguggucauaacuuaacacucagggaauuugggugaaaggaauguaggguucuuuuacuuuucuggcaguguuucuaugauuucaaaauuauuuaaaaauaaaugauuaaauggcuauugucaaaaagauaaagguaacaaguguuggagaggauguggagaaaggggaacgcuugcaucccguuggugagaauguaaauuaguacaaccauagaaaacaguauggaaguuccuugaaaaauuacauauagaaguaucaugauccagcaaucucacuuuuggguauauauucaaagggaaugaaaucaagaucuugaauagauguauguacuccuggguucauugcaacauuauucacaauaaccaaaaaauggaaucaguguaaguauucaacagauaaauggauaaagaaaaugugguacauauacccaauggaauacuauuaagcuuuauaaaagaaggaaauccugucauuugcaacaacauagaugaaccuggaggacauuauauuuacuucaugaucucacuuauacguggaaaaaaguuaaacucagagagaguagaauggugguuaccaagggcuggaagggauucaggguauuggaagggauguugaucaaaggcugcaaaauuucaauuagauaggaggaauaaguucaccagagcuauuauacgacaugagaccuagaauuaauaacacuguguuuguauucuugaaaauugcuaagagaauugauuuuaaguguucucaucacaaaaaaauaaguauaugagguaauacauagauuaauucaauuuaaccauuucacaguguauauuucaaaacaugcuguacacagaaacauauucaauuuuuauuggucaauuaaaauaaugcuuuuuaaaaauaaauuauuaaauuuuagauaaaacaauuauuaaauuuuagauaaaacauaguucuuagaauauuucuuaugguuagcaugacugcugccugguaaacacuuugcuacauauucuaccuagucccaaaauaaguuauuuauuuauuuauguuuuuagagacggagcuucccucugucacccaggcuuggauugccucccagguuccagugauucuccugccccagccucccaaguaucugugauuacaggugcaugccaccacaccuggcuaauuuuuuuguauuuuuaguagagacgggguuucaugauguuggccaggcuagccucgaacuccugaccucgugaucugcccgccuuggcgucccaaaguguugggaugacaggugugagccaccgugccuggccuauacguauguuuuaaaaguauagccaacgggauuugccgacagguugaauauaggguguaagaaaaagaaaggagccaaggacuuuaaguuguagggaaaaacaguauuaccaauaauugagauggagcagguuauaggaagaguacaccugaggauaaaaaguacagucauguguugcuugaugacggggaugcauucugagaaaugguaauuucggcauugugugacaucauaggauauacuuacacaaaccuagaugguuuacucuuuugcucugaucuguacagcauaucacuguacugaauacuguaggcaguuguaacauaaugguaaauguuuguauauuuaaauguagaaaaaguacagucaaaauacaauacaaaggauuuaaaaaugguacaccauggagguugcagugagccgagcugagaucgcaccacuccacuccagccugggugacagagugagagucaaaaaaaaaaaaacaguauaccuguauagguauaaggcauuuaccaugaauggagcuugcaggacuggaaguugcucugggugagcaagugaguagaaugaugaaugacugugaaggcguaggacauuacuguacacuacuggggacuuuauaagcaccuuacuuuuagacuacauuaaauuuauuugaaaauauuuuuucuucaauaauaaauuuuagcuuacuuaaggaaagcuuaccguaacuuuuuaacuuuauaaacuuuuuaauuuuuuaaauguuuugauuuuuguaauaaccaguuagcuuaaaacacaaacacauuguacaaauucuuccuuauaucuuuaauucauaagcuuagguauuuauuuguuuauuuuaaaaccuuuuguuaaaaaccaggacaaaaacauacacauuagccuaggccuauccaaaguucauaucaucaauaucacugucuuacaccuccacauuuugucucacuggaaagucuucaguucucaucuccuauuauaauaaugcuuuuucugagacuaucucuugaaggacuuggcugaggcggucacuuuuuuuaguaaguaauaggaguacacucuaaaauaaugagaaaaaguauaauauaauaaauacauaaaccaguaacauagucauuuauuaucauuaugcaacuggcagcacuguagguuuguuuacaccaguaucaccauaaacacuugaguaaugccuggugcugugauguuacaacagcuccagcaucauuaggcaaugggaauuauucagcuucauuaauuuuaugggaccacuguuguacaugugguccauuguugacugaaacauugcuaugugguacaugacuacauaugaauguagaggaagggagaagucaaaaaacugagcccugggcauuccagcacauagcggugugggagagaggaaaucaccaacaauggagacugagauugugcacugccaagaagcagaggaaucccugcccuuacuggggaguucaaaaacagguuggcauuggaaccuaaaucuauucucaguggcuccaaaagaguagcagcuagugaaacaagggaaaaccaugggauuauagcgugcuagaaaccaaaugaaaaaaagcauuuccacgaaggcagacugaccaccugugugaagagcuacuacaagccugaacauaaugguuucaggaaagaaugggcagggaagaauaggagacgguaaaccuagaggagucuuuugaagaguuuugcugcaaaagaaaugggguaguugaugaugggagaaaaggaguaaagaguuuuguuuuuagcuggaaaaacaaagcauauuuauauguugaugggugugauccaguaaaaugggaaaauugguguuaacagaagagggaugaaaauuacugggcaggcaagacggggugugcuuuacugcacaaguggaaggcuggcuuuaacuagaaacauggacguuucaucauccauuguaacaggaggggauauugacugaaaagugguggaaguuuguggaagaucuuugauuguugcuaauuuucagugaaaugcuaagcaaguacauuagcuaagauuaagaaugggggaggaaauacugaugauucaaaaagaaaaaagaaaguaggaaauaguuauuuaagaaaguagggaagugaauggacuagagaaaugucauauguuagccagucagccuuaauguuagccagucagcagccuuaauggccuaccugaaguaaguggucauguguuugaagugagaucaguucaauuauauucaggcagaaugugggauuuaaccaggguagguuguuuuaucuagggcaaacguugaggagagugaagugagcauacauaauugagugagagaaagaggaguugauggugugugugugugugugugugugugugcaaagucuuacaggaccugguggguuuguaggauuauugguauuugggcacuagaggaagugaaucauuugguuggauauugaaaucaucaaaaauugccacaggacuaauguuggagaugguaauagugaaccaagaacuaaaaucuucaaggauugagggagaaugaguagauguucauugaugacugcagcguggaggaaaguggaugguguggugugaugauaugagauucaaagcugguuguauucagggcgauggcaggaacagaacuguaacaaggaacaaggagaaccaccucacucacaggcccaguuccauuuccuaaacagacgaauuuguauucccuguaacucauuagccccuagucuucugaauccuuuucuaagagaguaaguaaaauaaaugaaagcauuaagauacauuaauaauuuuuauuuuacaaauauuugaguuagugauucugcagaguuuuauuaauaauucaaaaaacugacuuuaaccugucacuucaaaauagguuaaauagugcagcugaguuacgccucaaaaguuuuuaacuuguuuuggaaagaaaauuguguuguauguccaacaaaccuauauaugauuguuuauuguguauugauguacauaccagagacuguuuuuguauauuuacugggcgcuuaauaaauuauuugccuaauauuuaguuaucucuccuuuuucuucuagauuacauaccgguuacggcaccuccuucgugcaaggugugaugcauccccagugaccaacaacaccauccaauuucacugugauccuaguuucugggcucaaaauaucaucaacuuaggugggccauuaccauuacauacauuucucaguggcauuugucuguaaaacucaaugauuaugacauguuacugaaaauauguucacuuaggcugggcacgguggcucacaucuguaauccuagcacuuugggaucucucaaggaucacuugagcccaggaguucaagaccagccugagcaacauagggagagcccauuuccacauaagauuucuaaguuagcuaaggguaguggcacaugccuguagucccagcuacuuggaaggcugaugcuggaggaucgaagaaaauauguucucucacuuugaaaacguuuucauuauuuuguuuuaaaaagacauguuguuucuaauaguauuucauuaacguauguauaugguaacaaauauacaugaauauaaacacacauacauguauagcugauaagaaaacauucuauaacauugacugacagggugucuagacuuagggauuuagguguccuguccuguccuauucccuuaaccccccaaaucugguuuguucucuuagcucuaaauuuaucagaauggguuaacuugacuugucauugauaaaggauuuuugauauccugaaaguuuuauuuuaaacuacuauauuuuuauuggcuuaucuuuacaacuauucaauaggaacuuaaugguucaauccuuuaucuugcuuagggaagacuuuuaguuuucuucuuuugccugaucagguaauaguuauauagauaucuuacuaauugaaguaaaacauacauacugacaaguacccagaucuuaagcaaucaaguacugcauaaugauaucucaaucaguuaacugcaucuaugacuuauaaauacaguuuuuuuuuuuacuuuaucuuucguauguuuagauacacagauacuuaccaucguuuacaguugccuacaguauuguccagauaauucaguacaauugcaugcuauaccgguuuguagccuagacucuaccuagcaauaagcuaugccauauaaccuagguguguaguaggcuauacaguguagguuuacauaaguaaacugauguuugucuaaagauaaaauuaccuaaaugacacauuuaucagaacauauccccauccuuuagcaacacauaacuguauuagaacucacugaauuaucacaaaaagagacugucauuuugguaacauuaggaagaaaaguauccuugcaagcaguucagcagaaaguuacuacuuuagcuucuuuauuguacuauuugcugaguagaaacaccuuuuugccuucuuucuuaauuucucacagggaaacuauacaaacaaauuuaagaauucccuacacauugucuguuuaucaacaaacaauauuaucuuugaugauuuuggugggggguuggggggugcucguugaauuuguuucagagucaucaaagaugguuucuuauccccaacacuagauucuggguaagaaaagaaaauggcuggagaaagagcccauacucaccaggaaaggaggaaauaggcaaucuaacccauaagggaagaacaaaaagaaucccggaagcaaaggugauaaggagaccccugcagacuaguuuagauacagacauauguauauugauacauagcaggaaacuggaauuauuacacacucauuuuaccaaaaagcaucuuuagaauacagaacauguguauaaguaacuuauugccacaccugacucuaccaccacacauucaucugaacucugaacccaucacaagauauaaauccaaacaaguggucauaugugcuauguacuuauaucacaauagguaaauacacccacauauagacauaaguacauuuaagaauuauauuuaaaacuguacacacauaaauggauauaguuucagauaaaucuaguuuagccaaaacaaaaacaggaucuccuagucuaauaguuugugaaaccgacauaaugaaguuaauauauuuuacuguaggauuucuuagagcugucauuuacagcacuguaaauucauauacaaugagauuugcauuguaaaucucuaaagaaggagacaaguuuccuaaacuuguuacccauggcuucugagaaacauauaaaagcgcuaggggaaaauauugaucuagaugaauauuuuguuacugucuugagugacuuuagauaaguuuuacaaccucucuaaaccuuagaucccuuauguguaaaagagaauguuauuguuucuucuaaacauacacauauaccuucuugucauagugaauuacacacaguaaacauuuaaugaauaacuguauauuuuuagaaugcauaugauugguaaaucauaaacauuuaaguuucuacuguugaaaucaagcuugauucaggccuuucaagggcaccguuaaacucuuaaaacuaguuuuaagccagucaauguauucuguaucaaaaaguuaacauaguaugcauuguaaagguauaggaaacuugagagaucacaacuuguuaauaguaaagauucagaaauacuuuuugggauuguuuuuagagccaauguuagguucgcuuguuuugauauaugacagcaguucucaaaguauagucugguacucuuucaggggaccacaaaggccacccuuuuccagcuacacgucuggaugaguguugugccagaccucuguugacuucaguagggauaggaccauguuugagaggcccaagaagagaccuggagccagugaaugagacacagggcuuauuuagggaacuuacauacaggacaguccaguggaagugggcuggacaggagaaccaccagcaaguaguuuauauagcacuuagcacccucccgcuagcaaccuccauguggcaaccuucauuuaacacaaagcaaaaggcauccauccccaauauggccuggauuccacaggcugagcuggggguucagauauucuucauugauaaagaaugauaaucuccggguuggccacuccuagguuccuuaacgcagaacuccaaacacacauucuucuuaggccauacagggucacucacaggguacacuuaaguuauugcugucaggugcugucugccauacagugagacugaaauuuuuuucauauauuuuaacuuaacaauauauuaugauagauagugcagaaacagauaaugugauuucagcuauuaagccagacauucaaacagauuuuuuaaaacaucaaacaguauuuuaaaauaucaaaaaauguuuaccaaauauuuuacaauauaguuuuauaaaagcauguuguuaugguuuuauucuuaaaugaauuagaaaguuuuaaaaauuauucuuaauuucuaauauuauaaauguugaugacuagaaguuagaugaacaaaagcuguuuggggguucucuuucagaguguuaaagggcucaugagaucagagaauuucuuggcaauuuugaaguucugcaaaaauagcuuuagaaaaugugauauuucaccaacuaucugaaaaacuguuucccuuaaccuuuucuuuuuaauuagguucuuuaguaaucgaggauaaagagagccagccacaaaugccuaagcagaauccugucguggaacagaauucacagccaccaagugguuuaucaucaaaccaguuauccaaguucccaacacagaucagccuagcucaauuacggcuccagcauaugcagcaacagguaauggcucagaggcaacaggugcaacggaggccagcaccuguggguuuaccaaacccuagaaugcaggggcccauccagcaaccuuccaucucucaucagguaaauuuggaagcaggccuguccucacuuagauaauuauaguauaauuguguuuagcagcucaaaauaacaaagacauccauuuuccauacucuaaauaucugcauuuauaaaaauuuaucacauuaaggaucccugauuuaaugccuaguuuuuaaucccuacuuaaaaaggauuuaaugguuuauugaguugauaaaucuauuuucaucuacccuucauugucuuuaaauuauagugaaggauaaauguuuguauuccuaaauaacccaggccugugauugaugggaaaaguugugugccuauaauuccuauauuggugcuucagaaugaugaauacauuaagaaucugcccucuuugaggaugcaguguucaguaaaccacauugcaucuuagaaauuaaggcagagugaaauagaaaagggcagaagugugauucauuauaaucuaccuuuuucaaacuuuauuucugagcaaauauacugucuaccguucuuauuuuuacuauaauccaauuuuuuuuuuuuuuuuuugagauggagucucacucugucacucaggcuggagugcaaugacacgaucucagcucacuacaaccucugccucccggguucaagcgauucucccaccucagccucccaaguagcuaggacuauaggcaugugccaccacacccggcuaauuuuuuguauuuuuaguagagaugggguuucaccuuguuagccaggauggucucgaucuccugaccuugugauccacccaccucagccucccaaagugcugggauuacaggcaugacccacugugcccagccccuaauuuuauuuuuuaaguugcuuccccugucacaggauucuuagacacuaacucaaucaaccauaacaguuuaggaggggggcggaaaucaccuuacaucuuaccagaccauaagcaucuucauggcauggucgacaucuuacauaccguagcacauuacacuggcauuaagugucauuuuuuugguugucaauauguaaacauuagucuggaugaagguggcaaaagacuucuaugacuaccuuuauucucccuuaaggaccauuuugggcuaagaaaaauuaucccuuagauaaauuuaaaagcuuuuccauguaauuuccuaaguauguucugcuuguauuucuaugauauaaaacccuucaauucauaaaauuuucauagaaaaauaaaaacauugcuauggcuuuuagguuuauacuuuuuuaaaguuucgagauuuucuuauuuuucucuaauauuauuuuucuacucuuuaccuacagaauuucacuugcuuagaaucagcuucuaaauguauuuuucacugggucuguaauugcuggccacucuugaaaguuaaugagagguaaacccagugccaacuaauuuuuaagagagaagcaguugacccaggugaggauaguaaauuccaaaaauaggaagaauaaaaauaauaaagaggauaggacuguacuuuauagcugucugccuucacagugucaaaguuucagguguugcugcuucaaccuuaaaagauuauuuauuuguccccugugaauguagggggaaauaggcuccucuuugagaaguugugaucauacaguuaagauauacuaaaaagaauauuuauuuugcaauacauucccaacuguagagaaucagucaagaggagacuggcauauaagguuaccuuuuucuucuaggacuggucucaauuuccagggcuaguauuuaugagcccacagagcaggcuugcuuucuagccuuugccuuguugcaggaaucagaggaccagagagaccaauggauggaacaggaggauuuuauuuaaguggccacuggcccaacagauucacauccaaaggcuaggucccaaacaaagacagggcuugacuuuuauacacacuucugaaaggguguuggcuaauuuaaauggcacaaaacucgugguacaggcaaggaggcuuacagaggcagaacaaaggcaguuugaaucaaacagugacagauuuuguaauccuuagcauagcuugugaccuugcagcugcauugaaagaaaagcaggagcuuauaaaaccuggaaauugaguaaugguaaggggcaugaggagauaguaaaggaauuuguuuuucuuaacuuugcucugaguggguguugggagagucucuggagcuccuuccuuugggcucuggcuuuccagauaguguuuucaaggcuuugucagggcccugccuauugcuggccuuggagugagucagcuaaguacaggaaaacuuguuuuccucuuuuuaauuucggcuucauuccccccuuugaugcucccuguaaaugaaguuuaauggaaagcaucucuaucacuuaauucuucaugaaaaggcagguuucuuccuuugacaaagguugauauuuaguuagagccauuagcugagugguaguuugccugguuacaagagucucuauggccgauuggauguuuuuaacaaggagggguaagagacaagggaguauuaagcaaccuccuaguauggccaggacuauuccuauuaagguuuuaaauccucugagggaugaaaaccagcccccgaagaggguaucuggagaccauccuuucuaagucugggcuggaacaugggcuaauuuuuggauuuuugcaguuauaucuucaaugaccuuuccauugucaucaauuucuaggcagcaauuaguuacauugaacuuucugcauaccccaccuuccugggcuaugagacuagucuaaagccagucuauuuugagaaauagcauuucucguuuuuguggcuuguuaggccaguagauuuaaggcccuugcagcgacauuagucaugauuucaagcacugccuauaacguuaugaugcaguugagcauguaaauagagguacaguauccauacauuccaucuuccgcccagguggcugacccauaauauuggauuauucucucagggggccauucaucaucuuucuaauuccuaugguuaugccccuuuuauuucuccuuuuuguuucaucauaaacaggguauccuaaggcuucuccuugccuuagagggauuaggcagaaggauggucugauugucccuaguacacaggccucuggcagcugcccauaugcccaugacccacagauccaguagaggccagagggugccugccaggcauuuggaguuucaagcugguaccaagagugauguaaagaggggaaacaggagaauggacuaggguggggugauuuggaauuauuuauccugccccaccauaaagucuuuccuguuguuucauuguaauauugcuguccuaggcaaguuaauucuauccuacccaguugguaaaggccuuuccccagcgaacaaugcagaaucucccgauaauagagauuuuuuaagggccagacgcucaagcuugugaauguugguucaggggagaggacagucagaguaaaguuaccuuggggcauuagcuccuuugcuuccuacugccauugauccccuaugaugguuccuccacaugcauagcaugaggagacauguaggcuacugacuauguuuucagccaguugggcaaacagguugcuggccaagggagaggauucaggcaacuccugguggaugugcucauagaaugacucaaaaacucggaacuguuggguugaaucgguccagguuuucuuuauaauauacagacugacuucugaguuuacuuuuugaccuuugacuuugaaccccaguguccugggauagccuguaguccauaugggcagaccuggcucuaagauggugagaugugcaggauagcaaaugcuagguuuaugaguugguuuuuccaguaguuucauauguaugacuugccuuggugguuguugauaaguggaccaagucaugcagcuccagcgggcuauuaacggggaccuagaggaacaaacggggcacacauuuuugcuuggaacaaguaccauagugcccuguggggccaaugauaauggaccacuacaggauugcuaccuccuggcaaacauugaaguauaaggauaugaccuccccauaaggggaagaggcuuugauuugguuuggaagauccccuuccuuaguaugaacuucaaaccaagucucaauagguggggacuuaggguccuaacauauguagggcuggcuauuuccugggucacagauugaauagguuaccugguuaugagcacaaguuccuaaguggcucccugcgcacucauaauaaauauaguacagcagaguccuaguuauggugcuccccgaccgcguaguauguaugcagugggggcacccuucuaugaguccauuuucugacacugguaugaggagugccaugauggggaugaguagcaacaaaguaaagaguagcauguuuauacccagcagggacaaaagaggucuuugcccccaggaggagguuggauaaagagacaggauaauaguaaaacaauuaguauuauaaggaaagcuauuggaccuaagaauucuaaccacauuuacuucccugauggugcucacgcuucagccgugcauagacuagucagcuucuggggugacuagagccgggcuguugucuccucaagcuucagccgugcauagacuggucagcuuccagggugaccagagcaaggcuguugacuucacuggcaaccuggucccaccguaggaucagcugggucagauggucuggguccuguuggcugguccacuugucuugggcugcugguuucagcugacugugguggauccaaggcacaguuccugcaacuuuaacagcagugggaguggacaagauuacaguauggggcccauccuauauggguccuaaagugguuggguuccauuucuuaaccuaaacagaguccccaggucuaaaagggugugaugggucuguuaggcuuaugggcauucuuuccuguacccagccauggauucuuugcauggcuuaucccuaaagccugcauuugccuucuuaagguuaauuccccuaguucauggaggucaccuuuaauuugaccuaugauuggggauggccaaccgaacaagaucucauagggcaaauagccaguuuguuuggugggggugcaccugacucagaggaggaccaugggcaggacuugaucccaucucagaugaguuuuuugccaauauuucuucaguagcuguauaaguguccaauucauguguuccacuuuuccugaacucuguggcuuauaggcuauguguaacuuccauuuuauuuuuaacagccuugcuagaucuugagcuauuucggcuacaaaugcuggaccauugucugacccuggagucaagggcaguccaaaucuggugauaaugucucuuaacaauacuuuagucacuucucaugcuuucucuguucugguggagaaagucucgacccauccugaaaaggugcagacaagcacuaacauguacggauagccucuggcucggggcagcucagugaaguccauuaguagguuuuuacaggguguggcuccuauuuacuguauuccuggggccgagugggcccuugccguggguuguucugggcacaaauuagauauuguuugcaaacggcucgggugauggcagugagccacagcacauagaaaugguguccaaguagucuuucuagugccguuuuccuuauuauaugaguuccuugauggaauugucuuacaaauuugggggucacuauuucagggauggcuagccucucaucagagaauuuccaccaucguucuucaauguaauguccagucuguuuggcacaccaggcccuuucauuuggagaguaauuugggaccucugggaggagaggcaaagcuagggcuuccuuuuuacaaugcgggguagucauuccugccuguuuugccuccaugucugcuuuucuguuuccuuuggccucuaguguuccugccuuuugaugccuuugcagugcauaacagccacuuucuuuggggccuauacagcaucuaagagcuguaggaguucuuccucguacuuuauuucuuugcccccagcaguuaaggguccucuuuccuuauauauagcuccaugaacaugcaauguggcaaaggcauauuuggagucaguauaaacauugacuuuuuuugucuuuugcuagcaaaagggcucuugucagggcuauuaggucugcuuuuugggcugauguucugugggcagaaacugagccucuaccacugaguccaauguuacuacugcauacccagccugccggaccccuuccaauacaaaauugcuuccaucuguaaaguauucaacaucuggguccuugagggguugguguguaagaucuuucuggcuugaggauaccucgccuacuccaucuacacggcaaugaagggggccuccugguuccaaaucaguugggagcaagguagccagguuuaggguauuuaugugaggauuuuugcauaggagcccuugguauugagucauucuuagguuugauaaucaaggaugccaucucugauccauuaaaguuauaaccgagugcaguaccuggauggucaguugcugcccuagagucaguuggucagcuuccugugcuaauagggcuguggcagcuagugcuuugaggcacagaggccauccuagugccacagaauccaguugcuuggauaauuaugcuaccgggccaugccaugauccuaugaccugaauuaggaccccuauagcaauuccuuuucacucauggacauauagaaagaaaggcuuaguuagaucuggcaauccuacggcuggggccugaguuagggcuucuuugaucugcuuaaaugccuucuccuggucagccucccacaggaggggcuccuuuucuccccucuuuuguggcuucauauaauggcuuggccauaaaugagaaauuugggauccagauacagcagaacccugcugccccuaggaauucucuuauuugucgcuggguguuuggaguggggagugcacaaacagccuucuuucgcucacugccaagccauuguuccccuugacuuacuucaaagccuaaauauuggacucuccuggagcagauuugagccuucuuccuggacaccuuauacaggagauggaggaggucuuggguuccuugaaagcagucuucuuggguuggggcugccaaaaaaaggucaucuauauauugcagcaaggugcaguugucauuuggcgggguguaggccuugagguuuaaagauugugggagauuuuuugaauccuugugggagucuuguccaggugaacugcgacucgccccauuugcgacucucaaaaugggcuaauuggugccaggugaagacagaagaaugcaucuuucaggucuaggcaaguaaaccaggcagcacuugcuggaauaagucccaucaaaguauauggguuugguacuaucggguggauguuuacuguagugugguucacagcacacaaguccugcacuggccuguauucuccagauggcuucuguacuggcaggagugggauguuccagggugacuggaauuugacuacaaacaugauuccauguuaguagagucgcucacucuaaguguuugugaacaccucauauggcuuccgggaaaaccagguacuggcaaacuaaacugggguugccccugguuuuagcucuacuaccacuggcaucuaaucuuuagccagcccggguggguuaucuucagcccauacuccaggaauuuuauuaaguagccucuauaauucaaguauuccugguuugugagacaguucugguggcuuuuuuguguauagccuccauuccucaguuugcaggacgguaaggguuaacaccauggccuuugggucagucagguuuagagucauauccccuuguagcccaaaagcaaucugugcuugcaguuuucagaguaggucucuccccagcaggggaacugggcaauuugggagguacaggaauucauguuggaccucuuguccuccuauaacgaaccuccuuggccaacaaaguggccucuucucugagacccuggugaccccuacaauaguuguauaguuuuuggauagugguccuauggaucggguuacuaccagcuauucagccccauuguccaccauaaaguccauuagcuggccccccacuucuaaugugaccaugggcuccugggggccuaaggagaaggagccuggucuguccuuguccuuauauucuucagucccugccaccccgaucaggucgguaucugguuccuucagggugcagcagccuuugacugguggcauuuuuguuucauagccuccgccauuuucuucacugcccucuggacacugauuuuuuccagugucccuuuuagcaucaugcacauuggugcuuaucuaaccucagccggcuuuugagccucugucugguuuggccccaucuccgucugugcccguguccacauccgcacccucuugcaaugcuaguuucccuuaccguaagggucacugcuaacauauuggccuuuuuccuaagccuccgaucugcuuccuuuuuugccucuuggucacgguuaauauacaucuugguggccacuccuauaaguuggguggcauucaugccugcgaaauuuuuuagcuuuugcaucuuccaccugaugucacccugggcuuguccugcaaaugccguguucacugugcacugauuuucagaggccucagggucaaacggaguguaaagcuggaaugccucacagagucucucauaaaacuggcuagggcucucaucagcuccuugaagaacuucugagauauuuccuauauugauugccuuuuuccugccuuccuuuagcccuugcaagagugcuucucgguaccucuguagguacuguaauuggacugcaugauuugaaucccagugggggucugcuucuggaaacuggcccugaguguaugccugaacguuaagugugccuucaggugcacuggcuucuaggcagcagagagcugccuggauuacccuccagcacuccucaguguuaaacagugucaagaggagcugccuacagucuggccacguaggauugugugucuggaagauggauugcauuaaaucuaugagggccugggucuucuccauguaggaggggguaugguguuuccaguuuaggagaucagugguuguaaaaggcugguagaugaaguuccguugccccccuuggacuugacccuguucaucauaauagauggguccccgugucucccuaagaggcauuugcauagcccaagcaugaccagauuggaggcagcccacuugaucaucuuaucuuucuucccugaccuccuggggcuccgaucuuuccuuuuggggugagucuuggagcauguuaccaucugaaucugacuccuugggggccguuggccucaguaaauggggguagauuggaauauauggaagaggaauuucuaucuccucuggcaguuccugcaaaacugguuucucuugcccuucccaugacuuuuucuuugucuccguauuugccagcaaagcugauuuuacuuucacuuuaggcucggucugagccacaagcauuuugcaguaagcugccaggcagggcugcaaccaugcaggucaaguuugaacuacauuuagccaugagucaauauaagggaauuggucugggugcccuggcuguccuucgaccccaaucaccaccuuaaauacauggccaauuguuucccuaucugugguuccuuuggcuggccauccgacacuaaaagagggccauucuauuucacagaguucucaaccucugaggggucaacuucaucccguaauccccugcauaaccuuucuuaaaauucuuuaacauacauuguaaugggguggguuuugacgacuucccucucauuuccucccaguuacagcgcaacacacucacucucacuuucacuucggaccgauuagaccgucccccucgcaggaguauuucagaugccacuuagcauuggaggcucuguuuugacccccacaauuacuaaauuguggggcaccucccuaagccauauguggaacacuguuagucccggucagucccaugguucucucagaguguauggucuacgcuaagagaacugcggcccccacacaucacuccccgcauugguuccuccuggaaccgccucuuucacaugcacucacacacuuccccgcucccaguuccucuuucucaacugacucugcaagccacucucauguccuggguugguuggggugugagcuugugagcuucccugacuuugcaagccacucucacguccuguguuugaccacuaguuacaccccgggaggugaucaggcuccccuuccauucuuaugggacagguccugccucgggcucaaaccuuaccacaauccuguagugcacuguuccuggaaucauccuguuccugcuuagguuccauugugcugucagguagggucaagggagagcugaucaccccucuggguugaaguucucccaguggcgccuggggucacaggucucucccggccuggggcuccagucucacaggcgaagagacaguaaaccuuucgucuccaaucccgggcgagcccccagaaaauguuucaggaaucagaggacuggagagaccaauagguagaagaggaggauuuuauuuaaguggccacuggcccaacggauucacauccaaaggcuaggcccugaacaaagacagggcuugacuuuuauacacacuucugaaaggggguuggcuaguuuaaauggcguggugggaaucuaauggcaugaaauucaugguguaggcaagcaggcuuacagaagcagaacaaaggcaguuaaucagugacagguuucauaauccuuagcauagcuugugaccuugcagcugcauugaaggaaaaacaggaacuuacaaaacuuggaaauugaguaaugguaagggggaugaggagauaguaaaggaauuugauuugcuuaagcuugcucugaggggguguugggagagucucuggagcuccuuccuuugggcucuggcuuuccagauaguuuuaucaaagcuuugccagggcccugcauauugcuggccuuggagugagucagcuaaguacagggaaacuuguuuuucucuuuuuuauuucugcuucagccucauuugugauuccuucacccagccuuccuguaaucaaccaggguuguucuuggagacuuugcuuugaaaauauguuuucuggccaggcacaguggcucaagccuguaaucccaggacuuugggaggcugaggugggcugaucacuugaggucaggaguucgaaaccagccugaccaacauggcaaaaccccaucucuacuaaaaauacaaaaauuagccaggugugguggggcauuccuguaauuccagccacuugggaggcugaggcaggagaaucacuugaacccaggaggcagagguugcagugagccaagaucggaacaagacuccaucucaaaaaacaaacaaacaaacaaacaaaaaacagaaaauguuuucuucuauggagacucauccucuaaguuguaauuacucaguaucuuaacagccagcuaagcacccgaacauguuuugguaaugauauggcagacuagauuuggauuaaagccuuggugugcugcuugguguuagcugugugacuuuuuucaaauuauguuuucaaacuuuuaguuuccuaauuugcaaaacaaagguaauaauaccuacuucauaagacucaauaacauaauaauauguaaaaugccugccagggcucaauaagaucuaaaacuuacuaaguguuacuaauaucaacuauuuucauuauuaacgauuuguucauuuugaguacacccacugagccagauuacuuguucaaaucccagcuccaugccuuauugucuuuguuaaucuugagcaaguuacuaaauuuucugugcuuuauuuuagcuuucuuaucuauaaaauagaaauaaucugugcuuuauaauaauauugcuaagaauaaauuagugaauacaugugaagcauuuaaagcaguaccuggcauuuaauaacugcucaauaaguguuagcaguuauuauucuaccaucacuuuauuuuuaggagguuucaaaaggguaguucuuugugaaagauaauugugaaggacuuagaaggauaccaaagacacauuuuauuuacuucccaacauggccuagguccaauucugguacaaucuacuuacaaaaucuagguggcaaucccucucccaagguucuuuccuaguaagguucuuuuaaaaaaguuguuuacacaaauucugaaagucugcccaucccccaccccucauucccuuauguaaaucuuaauaauugauugaucuguggcagaguucuauuuuucuguaaaaguuuuauaagauagagauuuauaauuuguuuuucagaagaagauuguuacuaaauugguuuaauuucuuuuuucuagcaaccgccuccacguuugauaaacuuucagaaucacagccccaaacccaauggaccaguucuuccuccucauccucaacaacugagauauccaccaaaccagaacauaccacgacaagcaauaaagccaaacccccuacagauggcuuucuuggcucaacaagccauaaaacagguauauaucuaccuucuuuucucaauugcuuuuucugcugcuuucuacuuucaaaucacaaagaauuuacagauuaagcaacagguuauaaagagccaagagcaagccuucuuuuucauuuuuuaaauaaaugugaauugcaaaguuugaugcuuuuuaucaguaagagaaauuaaaccacuuauguagaagugauggcccaauauaaucaaugaccauagguauuaauuuuuauaauaugguauggauaacuuuuaggugaguauauuaaauuuccuaagauaaaaguauucuaacaaauacaaguuacauuccacaaaauagaacaauaaaugaaucuuugaagcgucucaagaagauuucuuggaaacaaaauuauggcacaguuucaagagggaauacauauauaucugaugaaguuuaauauuuaauucauauuuaauaugauacagcuuauuuauuuuuauuuuuuuauuuuuuuugagacagagucucucucuguugccuaggcuggagugcaguggcgcaaucugggcuaacugcaaacucugccuccuggguucacaccauuucuccugccucagccuccugaguagcugagacuacagguacucgccaccacgcccagcuaauuuuuuuuguauuuuuaguagagacuggguuucaccguguuagccaggauggucucaaucuccuaaacucguaagccaccguaccuggccuccuuuuuuuuuuuuuuuuuuuuuuuuuuuuuuaaagucucucucugucacucaggcuagaguacaguggcaugaucucagcucacugcaaccucugccuuccggguucaagcaauuuuccugccucagccuccagaguagcugggauuacaggcgcccacuaccaugccuggcuaauuuuuguauuuuuaguagagacaggguuucaccauguuggccaggcuagucucgaacuccuggccucaagugauaugcccgccucagccucccaaagugcugggauuacaggugugggccaccauacccggcuguauuauuuauauacuuagugucuucagguaaaaauauuuucuguguuuuacauuaucuuaaaguuaucacaguguuuuuucuucucaaagcuccuaugacaacagccugucuagcugauuguagacugauuuugguuucuccaagaccaaaauaaagaugaugcaauuuucauaauucuauaacauccauuuuaauaaaaucauuuuaauauuuuauucuaaaaguauguacacucugugucuauacauaucuucguauaaucaauuugccuuugcuauaucaucaccaaauucucuuaaacaauauuuuaauuauuuaaaauaaaauucauaccuauuauuucaucauuagaaggaaaguaaaaaggacccaagcuucaguuuggccuuaaauucuacuuauuuuccuaauaauuuuguggcacuuacguagucuuuucgcaucucccuugccucagcuauaaaaugcguaucuugcagaguuauguugagaguuuauucuaauguauauacaagcaccuagcacaugcucaguauucaaauguuuaccucuucccuauuuauuguauuuuaaugaguagauacucuaagcauguuuuuuuaaaaugguuguugaccaaaaauguaaacaugaaugaauaaguaaaggaacaagccaggaaaaaaucuacugggaaauugcuuuuaaguaguagaugaguuuaacaaauuagaguauacucauacaguggaauacuuuucagauauuaagaaaaugcaguaaucuagauaugauuuucugaguacgugaggaaaagcauguuauagaauuuuugugagguguuaucucauuuguauguguguuuuccuccagccucaucauguacauagaaaaaaaccugaaacgauccaccaacugauuguucuugguagaggaggaggaaagggggcauagagguggggaauaugagggaggaguaggugguaaagaagacauucauguccaacuucauauguuucuguauguaguuucuacaauggaauauauaaauuagguuuuucaaaauuggaauguuucagacauuuuauauagugcuguucauuugugaaugaccauguuuggaaaauacggcaucuugcaguacacuuaguuacuuuccuucuuccagcaugaaaauuuucaaacauaauaaaaauugaaagaauuauauagggaacauuuuguucuacuugccuuauuacauguuuaucuauuccuuuguccauucaucaagucauccuuuuuuuuuuuuuuuuugaggcagaaucucucucucuguagcccaggcuggagugcacuggugcaaucuuggcucacugcaaccucugccuccuggguuccagugauucuccugccacagccucccaaguagcugggauuacaggugcccaccaccacgcccgguuaauuuuuguguuuuaguagagauggaguuucaccauguuggccaggguggucuugaacucuugaccucaaguuauccacccaccuugggcucccaaagugcugcgauuacaggcaugagccaccaugcccagcccaucauguuuuucaauagguuuugaguaaauuccagacagcagcaugcuucaccucuauauacuucagcaugccuaucaucaucuuaauguguuuaucucagcaggaaugauaguacuuuccucagauauuuaucgaggccuaauuaucuguucauauaugagaagaggaauauaaaauccugaaaguaccagucuguagcuuaguauuuucaaguauuucagauagggauagaagaaauguauguuuucaacccuccaucuuuaccuugaaguugcuauguauauauuuacauuuuuuuuccaauauguauaaaccugccaagauuggguacugugauuuucugguauauacuaacuguugucuuccaguaaaaaucagugcuuuuuacuguuuugguuuuuuuuuuuuuuugacaagauuaaugaaaauuauauauacuugugcagucuuuugcugucccauucuccuuccauguaaauuacaguugaacucuucuacuucauuuugugugagugauuacauagauguuguauuuuauaagcuuguugauagccuuuguucuucucuucuuguuacuguaguggcagaucagcaguggacagggaaccccaucaacuaccaacagcacauccucuacuccuuccagccccacgauuacuagugcagcaggauaugauggaaaggcuuuugguucaccuaugaucgauuugagcucaccagugggagggucuuauaaucuucccucucuuccggauguaaguagacacaaaauuuauacuagccucuguugaaaacuguuggccgggugcaguggcucacuccuguaaucccagcacuuugggaggcugaggcagacagauuacuugaggucaggaguucgagacuagccuggccaacauggugaaaccccgucucuaccaaaaaauacaaaaauuaaccaggcaugauagcacacgccuguaaucccagcuacuugggaggcggaggcuguggugagcugagaucaugccacugcacucuagccuaacagagcgagacccugucucaacaaagaaagaaaauuguuagugaauuuggaucugguagaaggcaugaauuuguuggauuauagguuguuuguuuuuacaaguuaauuuuaauccuuuagaauauuacaacaguaguaaaaauaaaaagauuaugaacauuggacacauaaucuaaugucuuucaagccaccggaguuaaagguguuuguaaaugagugauuauggugauggaucauggaaucuaagcugggaaaggagaaaaguaaggacauggaaagauaugcugggacguugaauggcuggacaucagaagagaugaagacaaguuuaauaauagaaauccuguuagaucauacugacaagugcaaaauuaccucugguuuauacuacauguaaauuaacucacucuccaaacucuuugucaguaugacuuuuuguuauuuauuauauuuuuaaaugauuuuuauuuuuaauagagaugggggagacgcccuauguuacccaggcuggucuugaacuccugggcugaagggauccuccugccuuggccuccuaaagugcugggauuacaggcaugagccacuacacccagccaguaugacuauuccaaaggcagaaagucugcauucuguagacagaucuccauauauaaguugauucuguguuugauccuuuuuuuaaucuaaaguuagauaaccuacugucgugcacauauacauacgcaccuaauguuaagaagcuuuuaggaaauaucuuguacucuuuacuuggaucaaauuaccuauaagauugugaaaauaacuuuuuuauuuucauuauuuguuuuucaaguugagaucaauuaauauuuccuaauaguugcauuguuaaucuuaccagagucauuccauuuuuaaaauaguuuuguauacuuuaaaugaguagaauacauauauuuucucaugcauggaugguucauaggaaaacuuacaucuaauccccauaguuuuauuuggcuuuuaggauuaucccacaaaguaaacaacuuuccuuguauuaaguucucaugaauuuagucauucuaguacuuuuuguacucuuugaaaaauauuggccaaguauugccaaaagaauauuaaaacaaaaaugacccuguauauuaaccaccuggcccgauuucccugcccccgaacccacagaaaguaaaauucuuucugcuuuuuccucugcaguccucauacaggugaaccuuuuuccaccaggcuuucuuaccugaaauuccucuuaggaauuacagaauaagcugaaaugagugacuguuuucucauuccucccaaaggugcuucauaacuaguaccauucuaggugcauaagcaagaaauugauucauuauauacaaacugugcccuauggcuguaggacuuaauuaucuuauagaauccugguugaacaagaguagaacuauguuaaagaauugaacuggauuuuaagcccaaagacauuggugggaaauuugguauauguaggcaugaaagaauuuuugugucuaaaguauuaaacucuuacucauuagggauuuguaaauauuuuugccuggcaaugaauaaggaaaagaaguguuauuuguauuccuguuauauuaaagcaagaaucuuuaggguucaccuuuucuccuacaaaacaacaguaauguauucagugagguuagugcuguagauauauggacuucgucuauuuagcacauacccagaguaucaguuguuaaaguaucccuuucagaggauccacuagguccuaucuaucugugugaggcuagauuuucuucauauuuuucaagcaaaaccauauaccacaauagauugaaugcuguuuagggagacauuaaagagauucgcaagaaauguaaaauugugauagucuucucaccaaguuuauguuuuucauauggcaagcuuuugucguuuauaagaauuuuuucaauuuuuaagagugugaaugacaugauauuccuuuugacuccuguuuuugaaauagcguccucaauauuuuacuaaggugaaacacuaagauagugaaaaccuuuauucaagguuguuuauggggaaaauaucuguuagaacuucucaaaugugguaucuauguuuuguuauucgauaauaauuauuaaguuauugaagcuuucuuauaaauuuaaaaguagcuuuuaacuugcaaaaucagaaugcccugaaauaauuucuuuucuuguaagauugacuguucaaguacuauuaugcuggacaauauugugaggaaagauacuaauauagaucauggccagccaagaccacccucaaacagaacgguccagucaccaaauucaucagugccaucuccaggccuugcagguaaagugggcuucuuuugauuuuugugaaaguuuuucuaguuuucacuuuacuuggaauaaaaaauuaccccucuucuccuuuuuuguugaaugcuuaaucugaguuuuucacuauuuaaaauuaguaugcuuucagagaaaacaaagguuaaauuucuuuauccuuucuuucuuuugagucacagucucgcucuguugccaggcuagagugcaguggugcgaucauagcucacugcagacucacuccugagcucaagcgaucucccaccucagccuccugaguagcugggacuguaaguaugcugcucuaccaaacguggcuaauauuuuuugguagagacagucuugaacuucuggccuuaagcaauccuuucugccuuagccucccaaagcuuugggauuacaggcaugagccaucauacuaggccuucuuuaccuuuucaauuucaacagaacuucucaccauuauaguacuuccagggggaaauugguguuauauucuuucuuguugauaaguugccugugauguggucuuuaagauguaauuugccuagggucaaaauguauuagugacaauaaguagcaaucacucuucuggugauuuguuugguguuuaauuguguuugugaaucuugacauaccuacucauuuccucugagagaaaaacgcuaauauuacuucugaggacguagguaccuuaaaccaaaauaugaaaagagaauuuaagucacucaacagucacaugaacacaauuuaaauggggaugcccguuuuaaacaaacuuaugacaaaauauagcagagaaacuguuuaucauaugacaaguuuauacaaauaaggaacacaugugguauugccaaaggacaugauaaguagauaauucccuaaagaggaaauacauuuauccaauauagcagaugagacaaaaauucauucuuacuaguggucauaagaaaaaucaaacaagauagaauuucuaaguuacugaauuagcuaagacuuaaauaauaaaaauagucauugagaaugugaugagagguacucucauacauagguggaagggguaugaguuggcaaaacauuccuggaaaccaucauagcaauauuacuaaaguuuacauuuauccaauauuguacugugggcaaaguaccuuauauguauuaccuaguaggauauuugcuucaaggggcuuggaaaauguauguacccuugaaccuaguaauuuccauuuuaauaugccaauuauaaggaaauaauuaggaacuggauaggcagaucguauuuauuaauauuuauauuacuauuaaggcauuauuugcaguaguuaaaauuuugaagcagugcccaaauaugaggauaaaaauaaauuagaaugugcucacuuguaaacagauuauuuaccuauucagacaaugcuuauguagaguuuuuaauggcaugcucauggacuacuguuuagugaaaacaaguauacagaaccauauaaaagauguaaaaguauguuuaaaacuggaaagagauauaucaaucaaccuuagcaguguuuauauauggauggagaaguuaugggcuacuuaaauguuauauauuuuuauaguuuucaacuauucuaaaaugaagcauguauucuuauauuaucaggagauuauaaauagccauuguuuugauugauuuugaggcagggucucacucuguugcccaggguguagcaaucaugguucacugcagccucauacgcuugggcucuagugauccuccugcuuuagccuucccaguaguggggacuacagguaggugccaccaggccuggcuaauuuuuuuuuuuuuuuuuuugguuagagacgggucuuuguuguccaggccuuuuauuuuuaaauuaaauucuccagaguuuacaaaccaaugaaaugauaaucuucauuuuaucagccacauccuguuguucaucaaaccuuuuagaacuucugucaauucggaauuuuuuuucuacuucccacuuucauuguauuccuacuuguuacuguuuaguuugggccuucaucaguucaaaucaauuauuugcaacaguuuuccuucuuucuuggcugcuuuuaauuagaucuuccuuguuccagucuacacuaccaccagagcauagcuucuuaaucuuuuuagggcaguaguccagaaucccucuuuuguuuauugccuuaagucugaacccauugaucuuucugugucuuccauuaguugguuuaauuuuguuuacuugguuuucuuuuuugaacuccuuuucuaucagcccguaccaccuuucguugucuucuguagcuuccacuggcacuagggucucacugagaucuuaccccuguuacucuaacacagaaagacuuggcaauguuuggagauguuuuugauugucacaccccaagcugggaaguauagagagaugccacugguaucuaauaauugguggaggccagggauguugcuaaacauccugaaaugcagagacauuccuccacaacaaggaauuaucuggcccaaaagucaauagugcagaggcugaaaaacccugccgguguaacaggcuguaacagacugcugaaaauucagcaacuacuuacuguuucauagaauuucaucaugguucccaguuucaauguagugcuaagugaacacauucaacaggacuucaaugcauaauuauucauucguuuuaugaauguaugguuucccccuccucaggaccuguuacuaugacuaguguacaccccccaauacguucaccuagugccuccagcguuggaagccgaggaagguaaacugacuaaaccauauuuucuaguauauaaaaaucucuaauuagauuucuuuugccaguguucaacauguuuugauacucaauauauuuugaacaauuuccuuuauuuuuaauuaaaauuuuaauaacuacuauauauuuuaaugaauuaguuaagggauuaacaaaaguacaaauuuaccuuugaagauagaagaauauuugucaauauguugaaaauaagaaauguuggauauucauauaauagcaaagaaaacauaaaaaugaauaggcauaacacaguacacuauauagaaacacaaauuuagagaaaagauaaaauuuuaugcuaauuugaucucuaaugacuaaauguugauucuacuuuaaaauaaauauacaguuauugaaauucuauauuuuaagcaacugcucuccucuucccugcauuaugccugaaaauuccuccuagcuagugaacccaguucuuacuuuaucauauggaagaauugucugagggagaaaaguuugccuuuaaucccaugagaacauagugaaucucuguaaaagcuuuuugacccacuaccuucuuuaaauaguauuguguaaauacaugauuauuucauugucuucaccaaaguauucacuuugcuacugacuagagaaggaaaugagaaagccuaaaaucagaugccaguucuaagauacuaaaucugguugccuaauuguaaagccucagguuuuuaaaaguuuagguuuauugaaacaucuuucuagauauauaacuauuuagauagguuaauauguaaaacauuuuuaucauaaaugaaacuugcauacaccaguuucauuuguuaugcaucauuaauugcugauguuaacauacuuauuguugugaagauacaguauuuuagaaaguuguuguuauacuuuuuaugagguauuuagcuuaacauucuuagauugcuuuuucuucucucucauacuuacagcucuggcucuuccagcaaaccagcaggagcugacucuacacacaaagucccaguggucaugcuggagccaauucgaauaaaacaagaaaacaguggaccaccggaaaauuaugauuucccuguuguuauagugaagcaagaaucagaugaagaaucuaggccucaaaauguaauuaugaaugcuugcaaugcuauuccuaugcaugguggguagggugagagaaucuuuuaaauagcucuuaggaguuuuuuuuuaauguuauauuuaaaaggauuuaaagacaauuugagggaaucucucaguaaauuaaacaaaaagacaaagauggaaaaacaggaaaguuuuuaaaaaucagaggcucagauauggaggcugggcaguuaaaaggagauauucuuucuuuaaucagaguuuuauacccaggcaaauuaucaaucagauugacuugaagauuaacuaaacauuuucgugcaaguucucaaaauaauucuuauguacucauucucaggaagauacuugauaauaugaaucaucaaaaauauaguaaaacaagaaagaagacauaagauuccaaaaauggaaucugacacagaagaaaaaggcaacccccaguacagcagcagcagcagcuugugcaguagucuguagcaggaagacauaggacucccaagggagaaaaaugcuucaacaguauugagaaucuccuguuggagauugugagaauaacauagaaauagguaccuagaaagauaagcaacugaaaauauaagguaauuacagagucuuaguaaaaacaaaaaguuguacaaaaaaugucuuaguacauuuugugggucugcagugaacaauauuuaaauaauaauaauaaugauguaaacaaacaccugaguacgaauguaacuaaaaacugugaugcaaucaggauauaaccugaauaugcacuuaaccaaaaauugugauuuucagaauacuuaaccaguacaagacaaauacugaucaguuagaauagauacuggcaauaaacaguuauaccaguaccuaccaacuaaaacaaucaaugcuuaaucaaaacuaaguuaaagggauggggugaaugguggugguggugguuuugugugugugugugugugugugugugugugugcgcgcacgcacgaauggaagcaggacgggguuggagaaucagaauguaaaaaccuaaucuccugaucuucacuaguaaggauuauagauguauugcaauuuuuaacaaucauuuuauuuagaaauauggagguaaacagcagaagaaaaagcuagguuugaaaauaguucuuccaaggaauaagugcuuuuaacuauaucuacauuuauuacuuugaaauuuuugaaaacauuugaaggagauuguuuuuguuauugauuugaaauuuucaccauccugggcuucaacagaaaguuuagauucaucuuauaauuuuuguaucuuagguauaauuugaaugaacagcuccagugagguauauauauauauauauaggucaugugguugacuuccacucuacccaacccauucucuaauuucuguagccauccccagacuuagauuuuuucucuauuuauuuugguauuuuuuaguagagguucaugucuucuaagccaguuagcaauaaacauauacccuucuccugaagauuccuuugaagcagccaggugcucaccagagaguggucuacaguucagaauugcauuagugauaaaauuuuuuuuaaagccaguuaaauauauuuuuuuucuacuacaggccaauuauccaagaagcauacucaccucccugcucuuaaauagcagucagagcucuacuucugaggagacugugcuaagaucagaugccccugauaguacaggagaucaaccuggacuucaccaggacaauuccucaaauggaaagucugaaugguuggauccuucccagaagucaccucuucauguuggagagacaaggaaagaggaugaccccaaugaggacuggugugcaguuugucaaaacggaggggaacuccucugcugugaaaagugccccaaaguauuccaucuuucuugucaugugcccacauugacaaauuuuccaagguaagauaguacuucccuucccacauucuuuuacuguaaacuuuugaagauuauuuuaacagaaagccuuugaaaaaacuuaaaugaaauuccacuuggcacaaguguauacuccaaaaucccaaugaauagucuagguuuucccauacccuuccgcuuauucuuugugcuucuuucaaaaaacuaaucauucagccugagcaacacagggagacccugucugucuguacaaaauaaaaaauuagccggguaugguagugcaugccuguagucccagcuacucaggaggcugaggugggaggauugguugagccugagaggucaaggcugcaguaagcugugcuugcaccacugcaccccagacugggcaacagagcaagacccucucccuagucauuacaaaaagaaaaaaaaauaacaggcccuuuaaauuaucacaagggaucaucauaaggaacaaugucccuaugcauaacagcuaccacaguuuauuaugucuuuuugccaggcaucgaacuguaucuuuuacaaguauuucaaguaaauucucauacccuauggggaugaugaucaucaucaugaccaagaugguuaagagccauuggguugaucucucaguucuuggaaggccauacuuuugaaaauuuaauuuuauaaacuuaagaguaacaagaauaguacaaagagcuuuucuaguuccugaauccuuuggaggaaaaaaauucaauuaugcccuagauaugugagcccuagauuaaauuuguuuagguguuucuuuuuuuucaauauauguaucucacaccuucuuaacuagauuuugauguuuguuaggcccuugcauuauauuucugcuguuuccucucagcauggugcaguauaccuagugguaugugguaaaugcucagugauuaaaauucaugccaaaugaacaauucuguaucauagaugucauggaggaggugggaaagggaaauagugaagagaggaaaugaugcauuaggaauucaaaaguacauuguccccuaacaguggagaguggauuugcacuuucugccgagacuuaucuaaaccagaaguugaauaugauugugaugcucccagucacaacucagaaaaaaagaaaacugaaggccuuguuaaguuaacaccuauagauaaaaggguaagucuuugguaagaugcauuauuguauuguagugcaauauuguacugugguaccuuuugucaaagagguguauauccauccagauuuuauacugauccuuuuuauuuaagaguauuuuuuuuuguuuacaaagguacaugaaucuuaaagacuguaacuuucuuuaaauuaaaaaaaucacagaauuaaugcauguauuuuauagaagcuuauuguaccugaacaagauggaauauguacccuagacuuuuaaucuaccuuaaguaaauuucuauuuuguuuuauuuccuacuauagauaagauuuuuccuuagaacugccaccaaggagcuggguuuuuucuuuacucuuccuggaaauaauuccuuuuuuuucacugaaugggacuagacuuaugcaucaaagccaacugauauauuuaacuguaaauaacauuuaaagcuaccaagucaacacuuuguuaccaaaaaaacuccuuugcuaaauuauuaaguagaacagucaauaugaaaguugucaugcaagaggggacgugcccauucacugccaguacuacucagugguuacugggauaaacccauaaagcagggaaguauaugaauagcagagcacaugguuggaccuucggcaugcagaaaggugccuuaggucuggaugcauauugagaagguccaccuccaguucuccuaagagacguacguucuuccuuuauagacuauuacuaauuuauaauacacagacuggagcaauaagugcaaauuuauuguuagaaaacuucaaaugguuuucuagugauugucuuaguucauucaauuacagggccuguucccaaauauugggaaggagagcaaaacuccgagaaucaguaauuuuuuuguauucaucuggguuuuaauuuuuagucugacacuuugggaccucugagauuguuauuuaaaauaagcugugaauucauuguuuuauaauauuuuaucucaguuuuuauuuauuuuugcuuagaagugugagcgccuacuuuuauuucuuuacugccaugaaaugagccuggcuuuucaagacccuguuccucuaacuguaaguauuaaugucauuuucugcauguuuacacaguggaaugcuuuucuggaauuuuaugagaaucuagcuuauauuaccauuuuucaguacuuuuuaauaucuaaaccuuaaaucuuaauaauacauacugaaugcuuugauccuauguagguacauuuuaguaaguggcccaaaacuucuguucauuucucagguauucuuucuucuuucuuuucucaucuauuuuacuuaccacugggauguuuagggugauuucuguuaauuuucuguauuucaggaguuuuaggcauguuuccgaagcuguuggaaaaaaaacuuugaaauaaagacaucucucccugcuacauuuuccguacuuauuuuucuuuauagguccagacuucaaguaaauaaguagacguuaccaauacaaaaaaaguugaggaaguaugugcgcaggugcuauugacuucagaaagguucauauugaaaguuugaugugacuguggccgggcgcgguggcucacgccuauaaucccagcacuuugggaggccgaggcgggcggaucacgaggucaggagauagagaccauccuggcuaacacggugaaaccccgucucuacuaaaaauacaaaaaauuagccaggugugguggcaggcgccuguagucccagcuacucgggaggcugaggcaggagaguggcgugaaccugggaggcggagcuugcagugagccgagaucaugccacugcacuccagccugggcaaaagagcaagacuccgucucaaaaaaaaaaaaaaaaaaguuugaugugacuuuaacgcauaauuuuagagugcuggaaagggccugguaccccaaaagaguauucuucuaaugucugaaccccggaggcggagguugcagugagccgagauugcgccauugcucuccagccugggcaacaagagcaaaacucugucccaaaaaaaaaauuuuuuuucauuuguucuacaguuugauaaaucucaaauuaauacaaaguugagaagaaaaucagcuuaguaaauacagucagcuucucucuuaagaacagguuuugagaacuugauauaggaaauaaauaccuccagggagaagggucuuuuguacccaaaagaggcaggguaaagaagucgagaggcuuguaacaacauuaccaacuugaaaauguaaccuugaauuguacuuuuuauuauccuggcuuacaguuacguuauuaauaccaacaaugacaaaguagcccccuuuuucuuaauaaauaucaucucauuuagucuguacaaaaugcugugaguuuggcaggauuaucccuauuugaaauaugaagaaacugagguuaaguagcuuacccaggaccaugacacugagcagcagagcuggggauuaaacccagauucaaaguccuucuuccucuuguauaauacaugcagcaaaaacaugucagauucuacuagaaaugauauucuuccuaguaauugcuuuuuguuuaauaaugaagaaaaaaaucuagaugauuaagaggaaauaugugaagacaaguuuuuucauuaaaaauaauuggggcugggugcaguggcucacgccuguaaucccaacauuuugggaggcugaggcaggcagauugcuugaacccaggaguuugagaccagccugggcaacauggcaaaaccccaucucuacaaaaaauacaaaaauuagccggcuauguuagcgcaugccuguaaccccagcuacgcgagaggcugaggugagaggaucacuuaagcccaggaggcaaaguuugcagugagccgagauugugucacugcacuccagccugggugacagagcaagacccugucucaaaaauaauaauugguuaaacuuuuggaaaaagucacacaaaccuuuaccaguguguguggaaggcagugggcacuuguaaacacuguuaaauggguuucuuuacuaauggcaaauagcacagagaaaagcaaugagaacauucugaauuuuagagcacaucucauagaauauauuuaggacaagguggaauuuagcuauuuguauuauaacaucucauuuuuuuaauaggugccugauuauuacaaaauaauuaaaaauccaauggauuugucaaccaucaagaaaagacuacaagaagauuauuccauguacucaaaaccugaagauuuuguagcugauuuuagauugaucuuucaaaacugugcugaauucaaugaggugaggcuaggggagggaagggggcaggaaggaacagcagugugaaaaucauuuuauuacuaaacaccuugucaacauaggagaccaagaugucugaguuagaauaaauuuccaacuuuucagaucagggaaugcaagagauaauucagauaacucuguccacauuuauauucaaagguuuauuagauggugauggaaaugcaaauuacagcugauaacugaaagacaaaauguuuuucucugaccuagacauauucuuuaucauucccaccuguauuucuuauuuuuauguugaucuugaaauauuaaggaugugggccaaauagcucuaauuuaaaaauuucucaucugucaguucaucuacacaucagucagacuuagaaccuuuugcugcuggugguuuguucucuguuacucauucuaauaguacuacauuuaauuuguucuaaaaauaccugguucaugauccuaugguuauggaauccuaacugauauguguuuggcaauauaguccuaccauuaccaccuucuuuuagaauaauccaggcuuuuacuuuuaucuuuuuuccacacuucugaaucuuuuauuuuagcuggccuucuguacagagacuuugucuaguccuaaacuauuauuucaaugacuaugcaugaacacuuuucaaaacagcucauuaauauauauaaucucagaagucaaaaguguguccuuuuuuuacucauuuuuauuuuuacuccacagccugauucagaaguagccaaugcugguauaaaacuugaaaauuauuuugaagaacuucuaaagaaccucuauccagaaaaaagguuucccaaaccagaauucaggaaugaaucagaagauaauaaauuuagugaugauucagaugaugacuuuguacagccccggaagaaacgccucaaaagcauugaagaacgccaguugcuuaaauaauaugcagcaccacuagcuugugcugguuuuuagauuuuuuuguuuucaaaaaaacauuugucaguaauuuaacaucacuacaaaaagaagaguuugugacuauucucaucucuguuuuggacguuuacuagacuuugauuuccuuaauagcccauuucuguuaaccucuuaucacuaagaaagaaaggaaagaaggagaugaauagaagaaagaaaauggaaagaaggaaaaaaggaggauagaaaaaggauggaagaaagaagcauugaaaacaaagacauucuucccacuucuuggauuuuuaaaccacagucuggagugauagcuacuguagaaaggaaauagacuuuguaugaacucuuuaaguugaaaaguaaaaaauauaugugguuuggaugugugcuuuaauucagcuuuagaaauuaauaccacuacccgugaauuauauggccugacaauaugaauuagguguacuguacugaagaacaguacuccacaaacaugggugguaacaagaguuccaucccaggaggccaaacggugcaacagaaggguagguuagaugcuauuaagaaggcacuuaauaguacaucauguaagauggcaacuguauuaaagaaaaauccggaaaacaa

SEQ ID NO: 191596 - RNA, 10324 nt, Homo sapiens
gcgccagcgaccauggcggagcccacagugugcuccuuccucaccaaggugcugugcgcccacggcggccgcauguuccugaaggaccugcgcggccacguggagcugucggaggccaggcuccgggacgugcugcagcgcgccgggcccgagcguuuccugcugcaggagguggagacgcaggagggccucggggacgcggaggccgaggcggcggccggcgcggugggcgguggcggcaccuccgccuggagggugguggccguguccucugugcgccucugcgcccgcuaccagcgcggcgagugccaggccugcgaccagcugcacuucugccgccggcacaugcugggcaagugccccaaccgggacugcuggugagaaggcggcggcgggcggggacugugggcgcuggccgcgggccuggccguccugcuggaagcgggagcgacgggaaggggggcuucguccugccccgggccggggacgcggggcuggacgacccccucccgcaggccuuuccugggcguccucccccgcgcuuccagcagcugggcggaaaggcgcgaagguccucuccauggagacgucucaaccgcccacgccagaaaaguugcugcccccgcccgcccccccggauccugcgcgacgcggccggguuaaauccggacugggacuucggagcucacuuauucuggugauauuuggcgggagguggggggcguggggcgucugaggaucccaugagaucccuggacccuuuagccggaaaucgcugcucccccauauccacacacuugugcagaagcgggucugcgcccucuagguuuaacagcgcugagccagucucaccccaggaaacagggcuggauggcuugggugaggcccugugguuccugacugccagagcugggguucggggcugccuccugaccccaggcugugcuucacagccccgaauuuuccuugguugucucuagccacacaccccgccaaagcggugcuggggauaggggcgcuuucuuuuuaacguugguggacuguggcagcuguugccggggagaaggccaggugcagucgccuacggaacagaugugcauccucaggcgaggugggcgacccuuggcuucaaagcaucccuacugaaaauucaaaugacccugggagaggaguuccuucaacccaauuuucuuauuuuccaucagugcuuauuaggccauacuauccccgguuucaugaaaauuacucaacuucacauguauuaaauacauugaaagcugcucaaggcaaggaauuggacagacugguccuucuucaccugggcaucugaccgagggcuuuguucuuuuaggucuaccuguacccuuucccaugauauccacacaccugucaacaugcagguccugaaaagccauggacuuuuuggucucaaugaaaaccagcuucggauccugcuuuugcagaaugaccccugucuuuuaccagaggugagucaccaaggagucacccucaugucacauuugcuacaaguacuuuccccauuuauuuuucuuuuggcuuuacauauuaauuuuaauugccuucgaagcaacaugauucaguuucaaaugcuuuaaagguacccuuuauaauugcuaucauggcgaaauaguacguuuguuucaguuuagccauacacaaagaaguuuuaaaaacaaaauaguacaaaucccaagagaaaauuggaacaucaauuaagaccaccaauuaaaagcaagauuuucuaaucuagcacagugaugcuaucauagacaccuccacuuggccagaagagggaugggaagaaggggagauguugagaaaacagaggauaguucauaauuguggccugauuuuaacucuaaugcauuucagcgucuagaaaggaagauagccacaagacuagagguaggagcuggagccuuuggugcagguggcagaggcugcucucaaggcagcagaaucuguacccagaaggcaguccuggaguugaucucaggaacaagcagguuucuuccugacaugcauaaccuguuucauuucuucgagcacugaagccaagucugguaugucacgguugugagccagaggcauuccaaccaaccauguugcccaaaguagaugcaagcaguagcugaagcagguuauuggcaggaagggagaggaggguggcugcaccuaugaggcuggguccaguccuuccugucucagagagaaggcguggugccgcugcuauuugccuuuuaauuuuauaguacuuuuugauuuauagaaguuuaguguuuuuauuuugucaaaucuaucgaauguuuuuuugguaugcccuuuuuuaggauguaucuugggcccagccucaccuugucauauuagacuacuucaguguuuugugagcagcugauggguuggcugcacuuacaacaggagccuccccugugccuccacuuguccccaucaccugggacuggaaguaggugacauguggcacaaaacgugaucaugugggcagcagggacuguggaaaaacacagugcaugaggcaagaauggugccucacaucucuuguaugaaaugccugaugauugcuuuuaccacucucucaauaaaaaagacaauagacagguaaaguuucaugcuggugcauugauggacaaauuucuagaaaaauacagcuugucaaaauggauucaagaagaaacggaaagccaaaauagugucauaaaaauuuuuaaaauaaaagcauuaaacaaaccucaaagcauuaguuagaaggcuugcacaagaaaacaucagacuuauauaguuuuuuuuuuuuugagacagggucuuacucucucacacaggcuggaaguaccucggcucacuguagccucugccuccugaguucaagugauucucccaccucagucuccugaauaguugggacuacaggcacgugccaccaugcccagcuaauuuuuguacuuuuugguagagauagcguuucaccauguuggccgggcuggucuuauaugccugaccucaagugaucccucugccucagccuccuaaagugcugggauuacaggcgugagccacugcgccuggccaggcuuauauaguuucauaguugaauucuaucaaauuuuugucuuuauugaaguguaguugacaaauaaaaauuuuauauuuacaguguacaaugugguguuuuaauauauuuacauugugaauugauugcaaugauuaagcuaauuagcauaccauuacuuuacauggcuauuauuuuuugggugugguaaggacagcaauuuucagguauacaguauguuauuuuuuuaaauuuuauuuuauuuuuuauuuauuuuauuuuauuuuuauuuuuauuuuauuuuauuuauuucuuuuuuuuugagauggagucucacucuaucacccaggcuggagugcaguggugaggucucggcucacugcaagcucugcucccggguucaugccauucuucugccucagccucccgacaggcgcccaccaugaugcccagcuaauuuuuuguauuuuguuuaguagagaugggguuucaccuuguuagccaggauggucucgaucuccugaccucgugauccgcccaccucagccucccagagugcugggauuauaggugugagccacugugccuggccauuauguuauuauuaacuacagucaccuugccguacaguggauuuccagaaauucauccuguuuaauugaaacuuuguucccuucgaccuacauaucccuauucuccuuaauuuuaacaaaucuauaaggaacaggcuguuccuuauauuuggaguagguguaggaucuauuuuccaugaucuccaauucuugaaccacuaucauacuaauuaaaguaguuuaucuuucauuuuuaaaguuuauuuacucuuuuagagacauggucucgcugugucacccaggcuggagugcagagacaggguuuugccauguugcccaggcuggucauagcucacugcaaccucgaucuccugggcucaagcaauccucgcacuucagccucucgaguagcugggacugcagguguacaccaccgcacccagcuacuuuuuuuuguuuuguuuuuuugagauggaaucuugcucuaucgcccaggcuggagugcaguggugugaucucagcucacugcaaucuccaccucccugguucaagcgauucuccugccucagccucccaaguagcugggauugcaggcgcuugccaccauacccagcuaguuuuuuguauuuugaguagagaugggguuugucauuuuggccaggcuggccuugaacucuugaccucaagugauccgcccaccuuggccucccaaagugcugggauaacaggcgugagccauagcgccuggcccccagauacuuuuuuuuguuuuuguuuguuuguuuuguagacagagucuugcucugucgcccagacuggagugcaguggcgugaucuuagcucauugccaccucugccucccagguucaagcaauucucgugccucagccucccuaguagcugggacugcaagcaagugccaccaugccuaguuaauucguuguguuuuuaguagagacaggguuucaccauguugcucaggcugaucucaaacuccugagcucaggcaauccgccugccuuggccucccacaguguuaggauuacaggcaugagccacugugcccaguccacuuuuuaaauuuuucuguagagacagagucuugcuguguugccuaggcuggucuugaacuccuuggcucaagcaauuugccauccuuggucucccaaagugcuaggaguacagccaugagccacugugccugucuaauuuuguuuguuuguuuaaucaguucaugucuccuuuuccagauaagcuuuagaaucacuuaaauuccuaaaacuauuuuaaaggaauucuuugagaaggguagaaauugcauuaaaguuacgaauuuauuuuagaaaauuggcaucacaauuauaaauaggaugcuauuucauuuuaaaccaggucaucugugucuuguaggauuucccauauuuuagauuugacugauuacauuccuguaguacuauugaacauguuccuguaucccucaaauuuugaucagauuuaggauuuauuucacuuuauuuaauuaauuaauuaauuaauuaauuauuauuauuuuuugagauggagacucacucugucguccagccuggagugcaguggcgugaucucggcucacugcaaccucugccacccagguuaagcaauucugccucagccucccaagcagcugggauuacaggugccaccaugacuggcuaauuuuuguauuuuugguagagacgggguuucaccauauuggccaggcuggucuugaacuccugaccuuuugauccacccaccuuggccucccaaagugcuaggauuacaggugugagccaccacaccgggccuuauuuauuuuugaaauggagucucgcucugucgcccaggcuggagugcaguggcgcaaucucagcucacugcaaccuccgccucuauuuuauuuuauuuuuaagacggagucucgcuguguugcccaggcuggagugcaauggcacaaucuuggcucacugcaaccuccaccuccccgguucauguaauucuucugccucagccuccccaguagcuggaauuacaggcgugugccaucaugccuggcuaacuuuuguauuuuuaauagagucaggguuucaccguguuggccaggcuguuaugaacuccugaccucaggugauccuucugccuuggccucccaaagugcugggauuacaggugugaggcaccgcgcccagccaggauuuauuuuauagcaagaguuuuuuuacgugugcagcauuguuagggugacucagcagcccauuugccugggacugagggguugccggggaugucagacuuucauaguaaaaccuggacaguucuauuucuguugcaucacaucaggaggcauauaaugucaucuuugugugagcggccaagacugaugcgugguuucagggucaacagccugaucccaucauuauaaaguucccuaucaauguggucuuggugugucugggauagacccaguuuauauuaguugucccagugugauuauuaauagugcucccuugcagccuaaaaaugcccucgucuggaucauaaauuagaucuuugugccacccguugaaacugguuucccuggaagcagagccugagauagagacccagguaugugugauuuuuuugagggcgggcuuuucaggaaaacccagugugggagagagggaagcagggucuaaggaaggaaaagcuacaagcacauaaggucuggccuugacuucauucauggggagcuguggaacaaagaucacguugagucuagcuuugaggcacucuagcauuuuuuuagcuuuaucuaagucauucauuggcuacaggcuuuggggacagagggcaguucagcugagaguguaaaguaagagggggcagcugugagucacaagcagccagugcccacagcagcgggaguaugguuagcaccacuacacuaucaucaggcuuucccccaaagauuuuaacagccacuggugaucagaagaugucauuuagucuucaguuuagcuagagaagcuauagucuuuuggcuuaaaagauagagugaaaacuaauauuggccgggugugguggcucacaccuguaaucccagcacuuuugagaggcugaggugggcagaucaccugaggugaggaguuggagaccagccuggccaacauggugaaaccccgucucuucuaaaaauacaaaaauuagcuggcugugguggugaacgccuguauucucagcuacucgggaggcugaggcaggagaauugcuugaacgcgggagauggagguugcagugagccaagauggugccacuguacuccagccugggugacagagcgagacuccaucuccccgcugccaaaaaaaaaagaaaaacuaauauuucagguguucccucauuucuguaccaggucuguuugcucuacaacaaaggggaagcccuguauggcuacugcaaccucaaggauaaaugcaacaaguuucaugugugcaaauccuuugugaaaggagaaugcaaacuucagaccugcaaacggucccaucagcuuauccaugcugcaucuuugaagcugcuacaggaccaaggacugaauauuccaaguguuguuaauuuucagauaaucuccaccuacaagcauaugaagcugcacaagaugcuugaaaauacagguaggaauauccaagaaggacagagaaguaucagcgauaugguuuugcgaugcuucacugugaagaaguaagaacagugacaugaaagugagucugggggcaaagcaguuccuauguuaauuucaucuuuguucuugggaaaguuuagaacaggcaacauuguauuguauagaacggugauccuaaccaaaggagagaagggauggaguuuaucuuuagcacugucacugcuagcuacuagaaucuacccaagugauugaacaguagcuuguugguaaauuggaugucaggaaguagguagaacagguuuuguuuuuguuuuuuuuuuugagacagagucucagucugucgcccaggcuagagugcaguggcgcgaucggggcucacugcauccucugccucccggguucaagcgauucuucugccucagccucccgaguagcugagacuacaggcaugcgccaccaugcccagcuaauuuuuguauucuuagucgaggcgggguuucaccauguuggccaggauggucucaaucucuugaccucaugaucugccugccuuggccucccaaagugcugggauuucaggcaugagccacacgcccggccuaguagaacaguuuuaauggcauaguuaggaaaaagaggaaggagaugggccggugaguggaaaaguaagauuaauguagggauggcuuucuugucauaaauauaauuuuuggcuuuguuaauuuuuaaguaauuuuaaugacauuacagaacaauuuggaaaauagcaacuggaaaugaaaauuguauaugauuuugcucacucuaaucuacuauacuuguuacaauuuuauuauaggcccuucaguucuguuauauacaaacacgaauccaauugugcucaaaguauauguuaauuuaauaucuuaaauuucuacuuuauacaacaucauauuuucccauauugcuaggaauauugcauauucccauuauaaauauauucccauagucuuucaguaauuuuuauuguuguuuuugaagacaggaucuugcucuguugccuaggcuggaguacaguggcacagucaugacucacugcagccucgaacuccugggcucaagugaucuuucugcucagccucccugguagcugggacugcaggcacaugccaccauguccagcuauuuuuuaaaauuuuucuuuuguagggacaagguuuugcuauguugaccaggcugguuuugaacuccugggcucaagcaguccuccagcccuggccucccaaaguguugggaugacaggcgugagccacugcaccuggccuuuaguaguuuuuuagucuacaaagugugguuugguguucuuuuaauucuaaugcauucaguuacuuauucuguuacauuugcugguaccuagaaaucagugggugguaggcuuaggagaauugcuguugggaaagguaaaucaccaaaggcggaguugcuaagcuuucaccaucgaguuuucauguguugggauguuagugucagacguagugagugcagacagggagggcucugcauauaccagugucgggcuguuuagggaacugugaaugguggcagguaccuucuacccuaugcugugucuagggccugucauugucuucaucugguuucguuuggugagucucuccugugacauagugacuuuccgcuugcucucucucucucuauuuuuuauacacacacacauacaauuuuuuaaaauccagaagacaugaacucuccaaauccauguguugggagucuugucugauggcugguuagcugggcuguugcucccaacguaaaaugaaacuugggguaucguaggaaaacuuaucccuuuccucuuuguagauaauucaucaccuucgacugagcauucacaaggccuugagaagcaaggagugcacgcagcuggagcugcagaagcugguccucuggcuucugucccugcucagucggccaagaagcccugcccagguaaaccuuaaagggggucagugaacuaagaagaagcuuguccagcuuggaagaucugaaaacaagccuucuguuuagcuuuaauuuguaaccauucauucauuuaaugauagauuuguaauggucauaauaauaucuaccucacagugucuugcgagaaguaaagaagauggaaaaggagaaaauguccuuuuggaagaauacauuugggcaugggugguuggggauggggugggacauugaacaggcaaagagaggcuaaaauugagugcagauggggcuaguccagggcaagugcugaagauggcagcugcuaucugcagcuccuaggugcuuuccucaggcuggguagauggagcucugcugacuucugugguccaccauuguuuuucuaucaauuuauauuguggcaauccuagaguacuuugcacucauuuuuuuuuuucacuuaauauugucucauaagcaucuuucuauauuuguucacaucguacauaaucauguuuuugcacagauacauuaauauuaucauaguuuguuuaacuacuuggcuuuuucuaacaguuuuuuuuuuugagauggucuugcucuguugcccaggcuggagugcagugacgugaucucggcucacugcagccuugacuuccugggcucaagugaucaucccaccucagccuccugaguagcugggacuacagguaugcaccacgaccagcuaauuuuuuguauuuuuuuuuuguagagaggguauuuugccauguugcccaggcuagucuugaacuccugggcucaagcgaucugccugcuucagccucccagagugcuaggauuacaggcaugagccacugcacccagccucuuaacaaauuuugaauauaacuccugucuuaaaaucugcagaauauugaauuuuuccagcuauuuuuuacuuuugcuuagcuuauagaugcuaaaggauacugucauuugcauuuuuaaaaauauauguaugagugaauaguu

SEQ ID NO: 191597 - RNA, 10324 nt, Homo sapiens
aacuauucacucauacauauauuuuuaaaaaugcaaaugacaguauccuuuagcaucuauaagcuaagcaaaaguaaaaaauagcuggaaaaauucaauauucugcagauuuuaagacaggaguuauauucaaaauuuguuaagaggcugggugcaguggcucaugccuguaauccuagcacucugggaggcugaagcaggcagaucgcuugagcccaggaguucaagacuagccugggcaacauggcaaaauacccucucuacaaaaaaaaaauacaaaaaauuagcuggucguggugcauaccuguagucccagcuacucaggaggcugaggugggaugaucacuugagcccaggaagucaaggcugcagugagccgagaucacgucacugcacuccagccugggcaacagagcaagaccaucucaaaaaaaaaaacuguuagaaaaagccaaguaguuaaacaaacuaugauaauauuaauguaucugugcaaaaacaugauuauguacgaugugaacaaauauagaaagaugcuuaugagacaauauuaagugaaaaaaaaaaaugagugcaaaguacucuaggauugccacaauauaaauugauagaaaaacaaugguggaccacagaagucagcagagcuccaucuacccagccugaggaaagcaccuaggagcugcagauagcagcugccaucuucagcacuugcccuggacuagccccaucugcacucaauuuuagccucucuuugccuguucaaugucccaccccauccccaaccacccaugcccaaauguauucuuccaaaaggacauuuucuccuuuuccaucuucuuuacuucucgcaagacacugugagguagauauuauuaugaccauuacaaaucuaucauuaaaugaaugaaugguuacaaauuaaagcuaaacagaaggcuuguuuucagaucuuccaagcuggacaagcuucuucuuaguucacugacccccuuuaagguuuaccugggcagggcuucuuggccgacugagcagggacagaagccagaggaccagcuucugcagcuccagcugcgugcacuccuugcuucucaaggccuugugaaugcucagucgaaggugaugaauuaucuacaaagaggaaagggauaaguuuuccuacgauaccccaaguuucauuuuacguugggagcaacagcccagcuaaccagccaucagacaagacucccaacacauggauuuggagaguucaugucuucuggauuuuaaaaaauuguauguguguguguauaaaaaauagagagagagagagcaagcggaaagucacuaugucacaggagagacucaccaaacgaaaccagaugaagacaaugacaggcccuagacacagcauaggguagaagguaccugccaccauucacaguucccuaaacagcccgacacugguauaugcagagcccucccugucugcacucacuacgucugacacuaacaucccaacacaugaaaacucgauggugaaagcuuagcaacuccgccuuuggugauuuaccuuucccaacagcaauucuccuaagccuaccacccacugauuucuagguaccagcaaauguaacagaauaaguaacugaaugcauuagaauuaaaagaacaccaaaccacacuuuguagacuaaaaaacuacuaaaggccaggugcaguggcucacgccugucaucccaacacuuugggaggccagggcuggaggacugcuugagcccaggaguucaaaaccagccuggucaacauagcaaaaccuugucccuacaaaagaaaaauuuuaaaaaauagcuggacaugguggcaugugccugcagucccagcuaccagggaggcugagcagaaagaucacuugagcccaggaguucgaggcugcagugagucaugacugugccacuguacuccagccuaggcaacagagcaagauccugucuucaaaaacaacaauaaaaauuacugaaagacuaugggaauauauuuauaaugggaauaugcaauauuccuagcaauaugggaaaauaugauguuguauaaaguagaaauuuaagauauuaaauuaacauauacuuugagcacaauuggauucguguuuguauauaacagaacugaagggccuauaauaaaauuguaacaaguauaguagauuagagugagcaaaaucauauacaauuuucauuuccaguugcuauuuuccaaauuguucuguaaugucauuaaaauuacuuaaaaauuaacaaagccaaaaauuauauuuaugacaagaaagccaucccuacauuaaucuuacuuuuccacucaccggcccaucuccuuccucuuuuuccuaacuaugccauuaaaacuguucuacuaggccgggcguguggcucaugccugaaaucccagcacuuugggaggccaaggcaggcagaucaugaggucaagagauugagaccauccuggccaacauggugaaaccccgccucgacuaagaauacaaaaauuagcugggcaugguggcgcaugccuguagucucagcuacucgggaggcugaggcagaagaaucgcuugaacccgggaggcagaggaugcagugagccccgaucgcgccacugcacucuagccugggcgacagacugagacucugucucaaaaaaaaaaacaaaaacaaaaccuguucuaccuacuuccugacauccaauuuaccaacaagcuacuguucaaucacuuggguagauucuaguagcuagcagugacagugcuaaagauaaacuccaucccuucucuccuuugguuaggaucaccguucuauacaauacaauguugccuguucuaaacuuucccaagaacaaagaugaaauuaacauaggaacugcuuugcccccagacucacuuucaugucacuguucuuacuucuucacagugaagcaucgcaaaaccauaucgcugauacuucucuguccuucuuggauauuccuaccuguauuuucaagcaucuugugcagcuucauaugcuuguagguggagauuaucugaaaauuaacaacacuuggaauauucaguccuugguccuguagcagcuucaaagaugcagcauggauaagcugaugggaccguuugcaggucugaaguuugcauucuccuuucacaaaggauuugcacacaugaaacuuguugcauuuauccuugagguugcaguagccauacagggcuuccccuuuguuguagagcaaacagaccugguacagaaaugagggaacaccugaaauauuaguuuuucuuuuuuuuuuggcagcggggagauggagucucgcucugucacccaggcuggaguacaguggcaccaucuuggcucacugcaaccuccaucucccgcguucaagcaauucuccugccucagccucccgaguagcugagaauacaggcguucaccaccacagccagcuaauuuuuguauuuuuagaagagacgggguuucaccauguuggccaggcuggucuccaacuccucaccucaggugaucugcccaccucagccucucaaaagugcugggauuacaggugugagccaccacacccggccaauauuaguuuucacucuaucuuuuaagccaaaagacuauagcuucucuagcuaaacugaagacuaaaugacaucuucugaucaccaguggcuguuaaaaucuuugggggaaagccugaugauaguguaguggugcuaaccauacucccgcugcugugggcacuggcugcuugugacucacagcugcccccucuuacuuuacacucucagcugaacugcccucuguccccaaagccuguagccaaugaaugacuuagauaaagcuaaaaaaaugcuagagugccucaaagcuagacucaacgugaucuuuguuccacagcuccccaugaaugaagucaaggccagaccuuaugugcuuguagcuuuuccuuccuuagacccugcuucccucucucccacacuggguuuuccugaaaagcccgcccucaaaaaaaucacacauaccugggucucuaucucaggcucugcuuccagggaaaccaguuucaacggguggcacaaagaucuaauuuaugauccagacgagggcauuuuuaggcugcaagggagcacuauuaauaaucacacugggacaacuaauauaaacugggucuaucccagacacaccaagaccacauugauagggaacuuuauaaugaugggaucaggcuguugacccugaaaccacgcaucagucuuggccgcucacacaaagaugacauuauaugccuccugaugugaugcaacagaaauagaacuguccagguuuuacuaugaaagucugacauccccggcaaccccucagucccaggcaaaugggcugcugagucacccuaacaaugcugcacacguaaaaaaacucuugcuauaaaauaaauccuggcugggcgcggugccucacaccuguaaucccagcacuuugggaggccaaggcagaaggaucaccugaggucaggaguucauaacagccuggccaacacggugaaacccugacucuauuaaaaauacaaaaguuagccaggcaugauggcacacgccuguaauuccagcuacuggggaggcugaggcagaagaauuacaugaaccggggagguggagguugcagugagccaagauugugccauugcacuccagccugggcaacacagcgagacuccgucuuaaaaauaaaauaaaauagaggcggagguugcagugagcugagauugcgccacugcacuccagccugggcgacagagcgagacuccauuucaaaaauaaauaaggcccggugugguggcucacaccuguaauccuagcacuuugggaggccaagguggguggaucaaaaggucaggaguucaagaccagccuggccaauauggugaaaccccgucucuaccaaaaauacaaaaauuagccagucaugguggcaccuguaaucccagcugcuugggaggcugaggcagaauugcuuaaccuggguggcagagguugcagugagccgagaucacgccacugcacuccaggcuggacgacagagugagucuccaucucaaaaaauaauaauaauuaauuaauuaauuaauuaauuaaauaaagugaaauaaauccuaaaucugaucaaaauuugagggauacaggaacauguucaauaguacuacaggaauguaaucagucaaaucuaaaauaugggaaauccuacaagacacagaugaccugguuuaaaaugaaauagcauccuauuuauaauugugaugccaauuuucuaaaauaaauucguaacuuuaaugcaauuucuacccuucucaaagaauuccuuuaaaauaguuuuaggaauuuaagugauucuaaagcuuaucuggaaaaggagacaugaacugauuaaacaaacaaacaaaauuagacaggcacaguggcucauggcuguacuccuagcacuuugggagaccaaggauggcaaauugcuugagccaaggaguucaagaccagccuaggcaacacagcaagacucugucucuacagaaaaauuuaaaaaguggacugggcacaguggcucaugccuguaauccuaacacugugggaggccaaggcaggcggauugccugagcucaggaguuugagaucagccugagcaacauggugaaacccugucucuacuaaaaacacaacgaauuaacuaggcaugguggcacuugcuugcagucccagcuacuagggaggcugaggcacgagaauugcuugaaccugggaggcagagguggcaaugagcuaagaucacgccacugcacuccagucugggcgacagagcaagacucugucuacaaaacaaacaaacaaaaacaaaaaaaaguaucugggggccaggcgcuauggcucacgccuguuaucccagcacuuugggaggccaaggugggcggaucacuugaggucaagaguucaaggccagccuggccaaaaugacaaaccccaucucuacucaaaauacaaaaaacuagcuggguaugguggcaagcgccugcaaucccagcuacuugggaggcugaggcaggagaaucgcuugaaccagggagguggagauugcagugagcugagaucacaccacugcacuccagccugggcgauagagcaagauuccaucucaaaaaaacaaaacaaaaaaaaguagcugggugcggugguguacaccugcagucccagcuacucgagaggcugaagugcgaggauugcuugagcccaggagaucgagguugcagugagcuaugaccagccugggcaacauggcaaaacccugucucugcacuccagccugggugacacagcgagaccaugucucuaaaagaguaaauaaacuuuaaaaaugaaagauaaacuacuuuaauuaguaugauagugguucaagaauuggagaucauggaaaauagauccuacaccuacuccaaauauaaggaacagccuguuccuuauagauuuguuaaaauuaaggagaauagggauauguaggucgaagggaacaaaguuucaauuaaacaggaugaauuucuggaaauccacuguacggcaaggugacuguaguuaauaauaacauaauggccaggcacaguggcucacaccuauaaucccagcacucugggaggcugaggugggcggaucacgaggucaggagaucgagaccauccuggcuaacaaggugaaaccccaucucuacuaaacaaaauacaaaaaauuagcugggcaucauggugggcgccugucgggaggcugaggcagaagaauggcaugaacccgggagcagagcuugcagugagccgagaccucaccacugcacuccagccugggugauagagugagacuccaucucaaaaaaaaagaaauaaauaaaauaaaauaaaaauaaaaauaaaauaaaauaaauaaaaaauaaaauaaaauuuaaaaaaauaacauacuguauaccugaaaauugcuguccuuaccacacccaaaaaauaauagccauguaaaguaaugguaugcuaauuagcuuaaucauugcaaucaauucacaauguaaauauauuaaaacaccacauuguacacuguaaauauaaaauuuuuauuugucaacuacacuucaauaaagacaaaaauuugauagaauucaacuaugaaacuauauaagccuggccaggcgcaguggcucacgccuguaaucccagcacuuuaggaggcugaggcagagggaucacuugaggucaggcauauaagaccagcccggccaacauggugaaacgcuaucucuaccaaaaaguacaaaaauuagcugggcaugguggcacgugccuguagucccaacuauucaggagacugaggugggagaaucacuugaacucaggaggcagaggcuacagugagccgagguacuuccagccugugugagagaguaagacccugucucaaaaaaaaaaaaacuauauaagucugauguuuucuugugcaagccuucuaacuaaugcuuugagguuuguuuaaugcuuuuauuuuaaaaauuuuuaugacacuauuuuggcuuuccguuucuucuugaauccauuuugacaagcuguauuuuucuagaaauuuguccaucaaugcaccagcaugaaacuuuaccugucuauugucuuuuuuauugagagagugguaaaagcaaucaucaggcauuucauacaagagaugugaggcaccauucuugccucaugcacuguguuuuuccacagucccugcugcccacaugaucacguuuugugccacaugucaccuacuuccagucccaggugauggggacaaguggaggcacaggggaggcuccuguuguaagugcagccaacccaucagcugcucacaaaacacugaaguagucuaauaugacaaggugaggcugggcccaagauacauccuaaaaaagggcauaccaaaaaaacauucgauagauuugacaaaauaaaaacacuaaacuucuauaaaucaaaaaguacuauaaaauuaaaaggcaaauagcagcggcaccacgccuucucucugagacaggaaggacuggacccagccucauaggugcagccacccuccucucccuuccugccaauaaccugcuucagcuacugcuugcaucuacuuugggcaacaugguugguuggaaugccucuggcucacaaccgugacauaccagacuuggcuucagugcucgaagaaaugaaacagguuaugcaugucaggaagaaaccugcuuguuccugagaucaacuccaggacugccuucuggguacagauucugcugccuugagagcagccucugccaccugcaccaaaggcuccagcuccuaccucuagucuuguggcuaucuuccuuucuagacgcugaaaugcauuagaguuaaaaucaggccacaauuaugaacuauccucuguuuucucaacaucuccccuucuucccaucccucuucuggccaaguggaggugucuaugauagcaucacugugcuagauuagaaaaucuugcuuuuaauugguggucuuaauugauguuccaauuuucucuugggauuuguacuauuuuguuuuuaaaacuucuuuguguauggcuaaacugaaacaaacguacuauuucgccaugauagcaauuauaaaggguaccuuuaaagcauuugaaacugaaucauguugcuucgaaggcaauuaaaauuaauauguaaagccaaaagaaaaauaaauggggaaaguacuuguagcaaaugugacaugagggugacuccuuggugacucaccucugguaaaagacaggggucauucugcaaaagcaggauccgaagcugguuuucauugagaccaaaaaguccauggcuuuucaggaccugcauguugacagguguguggauaucaugggaaaggguacagguagaccuaaaagaacaaagcccucggucagaugcccaggugaagaaggaccagucuguccaauuccuugccuugagcagcuuucaauguauuuaauacaugugaaguugaguaauuuucaugaaaccggggauaguauggccuaauaagcacugauggaaaauaagaaaauuggguugaaggaacuccucucccagggucauuugaauuuucaguagggaugcuuugaagccaagggucgcccaccucgccugaggaugcacaucuguuccguaggcgacugcaccuggccuucuccccggcaacagcugccacaguccaccaacguuaaaaagaaagcgccccuauccccagcaccgcuuuggcgggguguguggcuagagacaaccaaggaaaauucggggcugugaagcacagccuggggucaggaggcagccccgaaccccagcucuggcagucaggaaccacagggccucacccaagccauccagcccuguuuccuggggugagacuggcucagcgcuguuaaaccuagagggcgcagacccgcuucugcacaaguguguggauaugggggagcagcgauuuccggcuaaaggguccagggaucucaugggauccucagacgccccacgccccccaccucccgccaaauaucaccagaauaagugagcuccgaagucccaguccggauuuaacccggccgcgucgcgcaggauccgggggggcgggcgggggcagcaacuuuucuggcgugggcgguugagacgucuccauggagaggaccuucgcgccuuuccgcccagcugcuggaagcgcgggggaggacgcccaggaaaggccugcgggagggggucguccagccccgcguccccggcccggggcaggacgaagccccccuucccgucgcucccgcuuccagcaggacggccaggcccgcggccagcgcccacaguccccgcccgccgccgccuucucaccagcagucccgguuggggcacuugcccagcaugugccggcggcagaagugcagcuggucgcaggccuggcacucgccgcgcugguagcgggcgcagaggcgcacagaggacacggccaccacccuccaggcggaggugccgccaccgcccaccgcgccggccgccgccucggccuccgcguccccgaggcccuccugcgucuccaccuccugcagcaggaaacgcucgggcccggcgcgcugcagcacgucccggagccuggccuccgacagcuccacguggccgcgcagguccuucaggaacaugcggccgccgugggcgcacagcaccuuggugaggaaggagcacacugugggcuccgccauggucgcuggcgc

SEQ ID NO: 191598 - RNA, 76752 nt, Homo sapiens
auggcggagccgcgcagaguagcguucauuagcuugucaccggugcggcggcgcgaggccgaguacccggggcccgagcgugagcccgaguacccccgcgagcccccccggcuggagccgcagccguaccgcgagccggcccgggcggagccgccggccccgcgggagccugccccccgcucggacgcgcagcccccgucgcgggagaagccgcucccccagcgcgaggucagccgcgccgagccgcccaugucgcugcagcgggagcccccgcggcccgagccgccgccgccguucccgccgcugcccuugcagccgcccccgccgcgggagucggcuucccgggcugagcagccgccgcggccgccgagggagacggugcgccuggagcuggugcuuaaggaccccaccgacgagagcugcguggaguucaguuacccggagcugcugcugugcggagaacaacggguacagaagauucuucccuccugccccagaccccgggagccucaggacccgccgccuuccccagcugguuugcaccuugggacgcccaccgagcgcguccgggucgccccgaggguggggugcggggggccggggccgagcggguggacggggcggugagcgcugcuuucuccacuccccaggguggccgaggcucucacccggcugcgccgaauccccaaacccccggcacucgcucccaacgccgcgccgagcucguuuucuugugcaccuuucggaaccucagauuuuccuucuuuccuuucugcuccccacacaaaauccuggggcccugcaggccguguggcuggguucucccuguggcgcuacagcugucguuccaguagaaaggaagagaaaaccuugggggacacgccccccagucugaagcagagauuguguaaccccucucguaucauccucauccucaucacuguuuguuuugcugggcgccguggcugcugaggugugcuugcgugccugugauauuuuucuuaaucgaagggaauuuaagaauaauuaaagguuuucagagacuaaggaucccacuuuaggaauggagaaguggguuaguuaaucugguuacuaauuuuucucucguguugguauuggaaaaccuuuuuagcuuuccuuuuuuguggaguucguucauauuguaauugaaugggaaggugucuccuguuuuauuugacaccuacccgucauauuauuuaaguguacuaucauuaguuuauagaaggauauuguauucagccuuuguaauuuucggaggaugaugaaaaaaaugucagcuuugaauuuuuuaaaauaauugaaaauauauagguaugcuuuugauguaagaggugaacaauggagaaaggauagggguuauguucguaauuguaauuuuuauuguuguggguugguggaucuucagaaguaaguuagaaaaggaaaugauagauuaacaguaaggaaagagaacaguuuucucuguugcuuagcaauuauacccguuauuagguuuugcuuuagcuugagucuaauggacuccagaagucccuuguuuuguuuucaucuucaacuaccuuuauggucaaaaugacugacugcuuagucacaaaguaucauguugaacaauuucacuagguuuuguuuacuucauggccagcuaauguuuugaucauuauuuagaaauguuauguggucaaaucauuacaaaauguuuucaaccaaaaugaauuguuuaaagguagagaucauuuuggucacuuccaccuaacauuuugcucgucagacucacuugaaugccccuucuuuauaaaucugaggucacuuuuuucccaaaagaauauuaaaaauauuggauuggagcauuuuucaaacauuguauuugagcugcuaaucuaaguugguuugcaguuuuuguaauuuucauaaauuacaggagaaaagcauuaucuuuggauaaaaauacauagcaauaacgacauuuacugguucuuacugugugcuagacacaguucuaagcacugcacaugguuuuucuaguaguccaacagaacuccacgagguaaaaacuauuauccucacuuuacaaauguauguaauuuuauuaguacuucuuuccauagugauacaauuuguuaguaaaacaaaauuucuuaaaauuaacucauauaguuuagaggauucugccaaaaugacguaaaauguaagucgcaguagaaauacaaagaccuuuauuaugucucuguuuaugcuguaauauucacacgauggcaaauuaauaauguguaucauuuaauuauaaaaagaaaaagguuugacacccuagcuuuguuaacuugauaacaccagaacuacuacuuucaugcaauaggagaaagaggaaaaauuccauuuaauuuuucuguauacuuauuaacaguauaggugucuauuggcccaauuaucucguauaucaaccuucuauuuuuuucauauaccucugaacaaaacaaaauccauuguauauaaucaccuuugcaacaaagauuugccacauuuuccugugauugcugccaguguauauccuuauuaugcaagaaagcauagaaaacauauguuuaaguaaaauugucaugguuucaugaaaggaaauccuagaagagagaccaucaaaaagcaaaaugcgaacauuagaauuggucuggaaaguuggugguucccaaaauuagaagaauuagaaaaggaagggcuccacauuuuugaaauagccaucuaucacuaaauaagauuuuagcuccagaugcugaaauugguagauguggggcuauuaaaaaaaaacaaacaacaaaagguguguuacauauggauaccauucaugugggugcauuuaaaucaguucccuucuuaaauacuaaaugaacaguaaaacccugauuuacuggaacauaaucagaaauuuuucuaugcucuauuuguauuaaugaggaaagcacaauuaaauaauuuauguugggaaaauaggaaaaacaaaaccacagguuagcuaaaccuuuaaccuuauugucucuaggcaguacagugcugugauugagaugguuuaggaugaugacuggcauuggaaucaucucuauccugaaagauuaauuuggucaccauuucuggcuaaaggguaauagugcauuuuagaaauaaauuuuggcaaugauugauacacaagaaaagguuuaacucuuaguaaaccagaaaaaucaguuaaccagaacacccauuugugaacaugcuuaauugaacauuuacuguaaaaagaaaaauaagugauuaaguguguuaauguaacuauacuauuugagaauuccaugguauuucauuguuugcguauuuuugaugaaauuugugaaagaccuccugaaaaugguguugaugaguuaagaucaaaggacaaaauuauugcaucaguuuugcauguggguaguugauaauuuucagauuuuuuuucaccugaaaaaacaaaaaagcuuaaucuugauugggggaggguguuuauucuuaacugugaaagaaaagugaguccauuuucuuaaauuuguuuuuguaggcugucaagagaaaauaagagcuguacuuuugauaccuacauaaaauacauaaaauauuuuagaauggcauauaaggugauucuuauuaaaaauauagauccauguguuuauauuuauacauauaaaaugagucauaccauaguaaguauuugggcuucacagugcaagagggagcaguuuguaauaggcauggcgauugcuuacuguccuuaaccugagccucugguuaaggcuacacccuggacaugccuaggauuccuuauuaguuuauucucacuaguuuauucccuuuuggaucauguuuauguuuuucauugguaaauuuuuauuuuuauuuuauuuauuuauuuuuuugagaugaagucucacucugucucaaccagguuggagugcaguggcgcaaucucagcaucucagcucacuugcaacuuccaccucccagguucaagcgauucuccugucucagccucccgaguagcugggacuacaggcgugugccaccacacccagcuaguuuuuguauuuuugguagagacgggguuucaccauguuggcuagccuggucuugaacucuugaccucaggugauccacccaccuuggccucccaaagugcugggauuacaggugugagccacugcgccuggccuuucauugguagcuucuguuggggugaacuauucuauaaauuuauuacuuauuacaauaauuuuaaaaauugauuuuaaaguuaacuccuuuaaagaaguaucccuuuauucuaaugucccaagugugaggaauugucucguauucauucuguccacauuuuucuaucauguuuuuuagaccgaucaugucucagucuuuauauccaggaugaagugucucaguuucaaagugugcacaucuuccuucugcauuuuuucuugcucuucaggguccauugaaucuguaucaauauuucaguuguaguauaccuuccuuuuuaaauuaccugagucaguugucugaaauuggauaaaaguaguauuuuuauccuuguuuugguuuuuuugugcauugaaaaccauauauauguuuguauacuaaaauagaagacuuaaggaugugaucgcuauuuuuguuuguuuuguuaaauagaugguuaaugugagcuucuagcucuguguguguguguguguuaaaccauguauuauaauaaacuuucacucuccccuacuagaagaaaggcaugguaauguaaucuuuuugcagcuauuucucuuuucuagcuuuguuuaaaaguaauguguauucccugaauggauauccauugacagaauauuggugauacaaugguuguugauauuggaccucaacagaaagccuuagccgcuacacacacucaguguuaacucacaggcagaugguugaaguguugcuuuuaauuaauaaucuagagcuccuuuuagaagcauuuccugaucaaagcaguuaaucuuuguuagugaagauaucaaucuagaauuauaagugagauuuucauauuuagcuaguguuccuggggauuuuuuuucuuuguuauuuuggaugaggugaccaugugaucauuuugcaggugaagacaauuuggauuguugaguucuuacucaucaaaacacugugaaauguauaugaguccauuauaacuguaaauuuuuuuugcuaugaaccaacuuuuuuuuuuuuaguuuuaauacuucugacuuacuuguuaguauuaggaaaaguugucucguauugguuaaauuuaagauauagucucugaguaauaauauaauuaauuauauaacauguuauauauucucacuaguuuauuuccuuucagaucacauuuauugaaauagaauugaagugguuguuacauaaugauaaauaaacaaacaauaauaauauuuguaauacuaauggauacuucucuuucuuuucccauucaccuugaaucagaagaagcucauucacacagaagacccauuuaaugaugaacaucaggagaggcaagagguggaaauguuggcuaagaaguuugaaaugaaauaugugaguauaauaaacugaucacuuagguaauuuuauccuauugaccuguuugcuuucuguggcugguugggagggccuauaaauauccguugccugccuuacuuuguucucaccaauggaaaccaaaugaaugguuagacagucaaauaaagauuccaacaggcuugugauaguuaaaguagccaucauucauuuuuauuuuuauuuauuuauuuuggaaacagggucucgcucuggugcccagguuggagugccguggugcaguguuggcucacugcaaccuccgccucccagguucaagccuuucucaugccucagccucccaaguagcugugacuacaggggcaacaccacacccagcuaauuuuuuguauuuuugguagagacgggguuucaccauguuggccaggcuggucgugaacuccugaccucaagugauccauccugccaaguagccaucauuuauuauagucuuucuagagucugggcgguuugcuuuacauauauuaucuccaaucuuuguaacaaaaccacaagcuaaguaauauugaccauauuuuacagaugaggaaacugaggcucugaguucaagauuaaguagcugauacagugucacacaguggcaagaguaggcuacagguccaggucuguguagcucuaacucuguucccuuuccgccaccaucgagaaugcuauuuuaauuccuuugguauaguaguucugaaaccuuccugccuccuaagaguuugagagugaauguguguacuucuaagcucauugcgucagacucagaaccagcaugagacuucuuugaaaguguccgguuuaugcuaaauauucauguacauuuuauauucagugccacaauauagugguguuuguuugaauacaaaaacaauuuuuaauuaccugauuaaguugcuuaacauuuuucucaaauuuucuaguauuacuaaauuuguagaaagccccacuccucaccccacauuuacacuauggcuuugaguacucuuggcacuuuacuaaaacauaacccaguugagaagcaacaccuuaccccucugauuccucugugagcauugaaaaguaucccacaggagaaaggauaucagcucacauuggccuugucauugagggccuuguacccucaagauacaacagggaucuugacccauaugugcuggcuccuugugguaauuaagaaaccauuugaagguagaagaaguagaugagaauagauuggaauuggaaucagguccuaggccauacuuugccaucugcuaauuguguccuuuuggugagguuuuuuagcuuugggccacaguuuucuuuuucucucuuuuuuucuaagacagagucucugucacucaggcuggagugcaguggugugaucuuggcucacuguaaccuccaccuccuggguucaagcaauucuucugccucagccaccugaguagcugggauuacaggcaugcaccaccaugccuggcuaauuuuuguauuuuuaguagagaugguuucaccauguuggcccggcuggucucgaacuccugaccucaacugaucuguccaccuuggccucccaaagagcugggauuacaggcgugagccauugggccuggccaaggguacaguuuuccuaucuauaaauugagagguucagauuuuuccgagacccuauuguucucuauucugugacuauauaauaauaaauuuagggauagacugguggguguuuaaauagaaggaauagcauuguaguauuuaauuacaguguaaucuuuugagacuauauuguaucaugauguauaaauuguaaaauccuauaggauguauaaauccuaaaauccuagcauguauaaauccuaaaauacuguguuuuuuauacaaguuauacauugguuacacuuaauguuuuaaccaacuaguacacuuauguggcucaaaauucaaaaauuaaaaaucuuccuuuuauuguauugcccacccauggaaucccacuuccuaggcaaguaacacuccugugguacuagagauacaucucuauacauacacaucuauuccuuucccacccccuuuuuauacauauuauagaauuguacacacuuaagcucuuugcuuuuuauuuacuguaucuuaguauauuugggggggucauaucaggacaaagugcuuucucucccuuuuuuuuaaggcugcaugcuguuucauugcauggaacuaucacacuguaaccaguccccaaaugauuuagguugcuuucaaaaauuugcccuuauuaauagugcugcaguaaauuagucuguaaaauggcauuuuacacaauuucaaguuuaucucuaggagagauuccuagaaucagacgauucaggucggaagauuuaugcauuuauaauuuuaguauauauuacuaaauuaccaguucuacucccuccaucacuauauuagagugucuuuuuuuuuuuuuuuuuuuuuuugaggcagaguuucacucuuguugcccaggcuggagugcaauggcgcuaucucggcucacugcaaccuccacuucccagguuccagcaguucuccugccucaaccucccaaguagcugggacugcaggcaugcaccaccaugcccagcuaauuuuuuguauuuaguagagauaggguuucaccauguuggucaggcuggucucgaacuccugaucuuagguaauccaccgccuuggccucccaaaauguugggauuacaggcgugagccacugcgcccagccuagagugucuauuuugcuguggguuacaaaaucaaggauuuuagaauugcccuuugcaaauggaaaaauuccuauauauaauccuauaaguaaagugauucaguauaugacgcacuaccuuaaaguuagcauuaagucuucuuagucaacccuaggauaguaucuggcauagaaagaucagcguucugaagaaguuguuugaugcgugaaauugaguuucaauugacuuagauauauuuaagccuuguuauuuuguuuacagugauaaaauauuacucuuguuauagucuaaauuaaugggcuauauuucuucucuggauuuuuauuuugcugacuuacugucuuauuuccauucuaauuagagauuguauguauauuaaccaaaaagcaugcccaaguguuauaucuaugaguauuguguguguguguauauguauauauauauuuauuugguagagacagggucuuguuguguugccuaggcuggucuuaaacucaugagccuaagcaauccaccugccucagccucccaaagugcugaguuuacagauaugagccacuguacccagccuaaauauauauauauauauauauauauauuuuuuuuuuuaaauaauuauuuggaaucuuuuaagaaaaucaucaggccaaaagugaccugagagaagauacauuguccugcugggcguuauaugccuagagcucuaggcuaucacaaaaucucucucuuaaacuacaaugaucuuuauugguguuuggggcagguguugcagcaguugaagaucagugauaucagaaauuacagggaguauaaaauuguaaaaagagcacccugcauugaauuuaugggguuccccccuccauuguguccuauuuuuauggccauguucuguuuccuguuauguuguucuuaugcucagguaaugugacaguucauauucagcaucaauuacuaaaugguuuuuugggaaaaggucaauaugacuauuaaguaccuauuuuuaccuagauuauacuaaauugguuguuguacauaaaucuuuuuaaauagcuaaguccaaguuuugacauuucuacaaccguauaggcuccagauucgucuugaugguuagaaaggaggcaggauacagguaaaagaggcucccaugccucucuuuauucccaguuaaggcuccaaaauguuuaggcaaaacaucuugguuuccaauucaguuuuuagauagucuguagguaauauaugccuuuuaugaggccaccuauacucuauacucaggaguaggaugcuucaauuugauggguauagacuuguuaucuuagccuucuaggacauaggauaaccuauaauuguuggaagauuucucuuagugauuuuuuucucacuccauuaccccagccguucugaaagaucauacuguccuagaauuggauauaaauucacuaaucuaaaugaaagcaccuaacacaauaccuugugccuagcaggggcucaguuaagacucuuugaaucugaaugacucucugaauaggaagacauauauucugccaggcauuuauuaauaaucaugaaaucacauuauaacuuuaaaaucugcuuacugugcuauauagaccuugaauacuaucuuucacacuuaguucuaugugguuuugggcucucagagcccuaguaguuucauacuucuuuuaaaaagaaggguaaggguagauuugauaguagaaaaguaauucugagcagucuuauaaauaaaacaguugaccaaauggaauaacacuguuuucacucaaagacaaauuauucuucuaaauacucuugauuuucuugagacccugucucuaauaagaauaagaauaauaaaaucagcuaggugaagcggcccgugccuguaaucccagcacuuugggaggcugaggugggcagaucaccugaggucaggagugcagccagccuggccaacauggugaaaccuuucuaucucuacuaaaaauacaaaaauuagcugggcauggugguggguaccuauaauuccagauauucgggagacugaggcaggagaaucccuugaacccaggaggcagagauugcagugagccgaaaucacgccguuguacuccagccuggcgacaagagcgagaauccagcucccccccccaaaaaaagucuugauuuucuuuuguauaacuuguaaaagugagucuuuccagauaauguuuuaaagaauggcaguaucuuggaauaacuaauuucugaugaguaacaucuucacaguaaauacuacucggcuaaguggaaagaaauauaauuuugucuuaaaauaauuauagauuauuguuuuaaacugucuucaaaugugaaacugauaccaaguaguuaguuuugaaagcauuuguguacuguuucugggaguuguaagaaucauaucaauuacucauauuauuuuaguugaucauccacacuugcugagggguuagagcuuccuugggaacuucauaggcugguuaaccuguuuguuuuggccuuaugugaggucuggucccuaaggaucaucucgauguagagcuuugggcaaacuuguugacaccaccacaaaguaaauucuacuugcaaaacacaaauaccaguggauuuaggguuuuguagaccaauaauaguaugauauuacauguacaauaaaaacauaaaauaaucuuuuaaagcaaacugggggaggggagagggccuuaaagggcaaggaggaauuccuagcucaaauaauaauuucuuuauugcaguuacccauucugaucacuugcugugacaugcccuuuuaauuccuuggccucuuugaauugaauaaauucucuucagccuucuuuaaugccuuaggaacaauugagaaucagcaguuuuaggguauuuaggaggaaggacugguauccauauguggugauuauagaaguuguguauacuauuuuugugcuguguagucagcucuuggcuguauuuccacugccuugaaacucagcuccuuucuauugguagguugaagaaaugggcacagauguaaagagauaagguggcagggcugggacaaguagggagucuugugacgacaggauguuuucuucucacuuauaggacugguguguuuuuuaguaaucagggucauucuugcucugucuacuagagguuaucaaugaauguugguuuuuaguuugguuuacuauuagcuggaggcaauuuggggucagggggucuaguacuaagaacaucuuguuuguuuguuuuccaguugaguguuacacuguaaugaggcugcauuggccuaaaacacugauugucagguuaagcaaguacuaaugacucaguaaggaauauucuucugagucacagggagcuaguaccuagaacaguagauaagaagaaaguucuucacuuuagauauagcaaaauucaaggguuuuuuuuuguucuuguuguuuggaaaauaaguuuugauuuuuauaagaucuacuuaauuuauaaacuguguaauaucaacugcagagguucagagaauuuaucaaguaagacuuugauucuguugcaguaaggguacugaaaaagagaguaauucaacagaagucuuucuaguagggaagauaguauaauccuuugccaauguaacuugaguuucuuuagguuaaauuuuaauauuugugaauuaauuuauauguaccuuucuggcaacugccaaaaguuugguuccagcuuauacaauuuacacauuauugaauuuuagcacaguuagggaacuggaggguggagaauagauauggggugguaaggcaggaggcaggucaggguuagaaguuuuccaggaaggccacaagugaggaaaagcaaacuguaccuagaaaacuacucuaauggccucugugaugaaggagggaacuggagauugugccuuauaguuggcaaaaaucuauuuauaaguggagcaaugccuuuggaacucugguuguuggagagugaguuaagaaagagcuacucagguuugggugugucaaauacacguuuuccaaaacucuuuccccacagugggacuggaaaguagagccaaaugaggaggaguucaaaacuuugguagugaacauuuggugggccaaaccuaauaaaauaacauuuauugaguggguaguacauguccuuaauaaaacucggaagauacaaaagcuaaugauagaaaguaaaucuccuuccuaccccugacucccagcuaaccaggucacuccuuagagacacugugaguuucuugccccagagagcuauguguaugugggcagucacauauuucaaagauuuuuuuuuguuacuguucacuguaagaggauauauaaauacagauaaaugaaaagaucaaaauaaaaaucagcaaaucaccuguaaguccacugccaggcagaaccacugugaauaguuugauaguugaaaguguauccuuucaggaguuuuaaaaauccaugugcaauuacguuuguacuuucuuacacuauaaaaaaauuuuuuuaagagccuagugugguggcucacaccugugaucccagcuacuugggaggcugaggcagagaagauaaaugucuugagccuaggaguucaagaccagccugggcaacauagcaagaccccaucucuuaaaaaaaaaguuagaucaccugagcaauacaugaauauguuccuuuuauuaaaaacaaauucaaauaauacauauuacaucaaagucuuccugcaccacugcuuccaguucuaucccuucucugucguaaugaccaugguuaucugcuuguuguguauucuuugagcauuuuauacauaucuauagauauauauugcuauguuuuguuuuucauagaugagaauauccuguucauaugauaguguaagaaacaauaucuuguuauuuagcuauugucuccauaauaaccaguuaaguugaggaccuuuucaaaugcuuagugaacauugauagcaccuuuucgugaauagccugagcuguacauaacauuuaggaaacucuucuuguuaccuucuauauuaauaaauacucucuaucacaauuuuuuaaaauuuauuuauuuauuuuggagacaaggucuucaucacccagacuggagugccgugaugugaucauagcucacugcagccuugaccuucugggcucaagcgauccucccaccucagccucccaaguagcugggacuacaggcacgcaucaccaugcccagcuuuuuuuuuuuuuuuuuuuuuuuugaaaaacaggauuucaccauguuucccaggcuggucuugaacuccugggcucaagcgaucaaccugcuucagccucccaaagugcugggauuauaggcaugagccaccucgcccagccuaccacauuauucuucaauggcuauuaacauugaauggauaugugauaguuuguauaauuuacacuuuuauaauugauaugcuuugugaagaccuuauaccuguaagaucauuuugaggggaagcauuuuggucagauuaauacuauuaugaucaaauaaagcuuuaagucuuuuauuugcuccccuugauaagauuuauacuuauuuaacaauacuaaucauuuuacuacuuagauuagauuauggacucagaacuauuaugguuucugguggcaacaaacuagucacuuuggcuagacauagauguuccuaaaucucuaauuacccauaaauuguuugcacuucuacauauaucugauugugcccauuacaacagaaccuguuuguuuaguuuucccagguaaaucucauaggcagcuauuuaugccuagacaaaaaauauguuaggagaucaaaaaagaucgucauugugauuuuaaugagaaagcauccuggagaaaagauugaaaauguaggcugauaugagaaagcugggaggauuaagugaguagcaggagacuaucccagauggggagaaagcacaaggaacaguaagaagguguguuugggggagaguugguagacaguuugaauggaugaaguguucauguuggaaaauuguaagaaaaaaguuggaaaggugguuugagucaacauguacaaggcauuuaacuggugccauguuaaggguuuucaauucuuauagguggagugcuuuugaagcauuuugagcaggggaaauaauaggguauuuuccaaauauuaauuaggugguaauuaugcaggauaaauuugaggaaagaggccaggcgcgguggcucacaucuguaaucccagcacuuuaggaggccaaggcgagcagaucaccugaggucagggguucgagaccagccuggccaacauggugaaacccugccucuacuaaaaauacaaaaauuagcugggugugguagugcgcaccugcagucccagcuacucgggaggcugaggcaggagaaucacuugaaccugggaggcagagguugcaguaaccugagaucauaccacugcacuccagccugagcggcaacagagugagacuccgucucaaaaaaaauuugagggaagagaggcuaauuaagacauucauuauguuuaggugaaaaacaaaggccagcauucuaguauugacaguuagaauggaaaggaagcuguagauaugguuaaucauggcaacaaagauuuauggggagagacacuuggaagcagaaauuaugagagacuuuugaaauagcauuauugagguauaauuuaaauaaauauaauucauccguuuuaagcguacaguuugauggauuuuaacagaugcgugcaauccuguaaccacuacuacaaucaugauacggaacaauugcaucaccccagaaaauucccuuuacagacagaucugucccuccaaacuuagccucuggcauccucugaucugguuccugugacucuaggcuuuucugauguuuguuuguuggccuuuucuaggguuuccuguaaauggaaucucaugucuucugcgucuggguacuuugacuuagcauaguacuuuugaaauuccuccauguauugccugugucccuucuuauugccgagcaguaauccacuguauuccuacuguggauuauguuccaccguuguuuauccguccaccagaugaugaccguuggguuguuuccaguuuuuggcugccaugagucaaguugcuauaaacgugagagugcaagucugugugugaauacacauuuucauuucucuugggugcauguaacagugggguuguuagguccaaugguaacuguaugcuuaauaagaaacuaccugauucgcugagagagagcuuuaaaggaaaaaaaaaaaacaaaaaacuaccaaaccauuuuccaaaguagccacaucauuuugcauuccugcuagugaugaaucagagaacaauugcuccauguccauguuagcauuugaugucaucacucuuaauuuuagccaauaaugguuuuaaggcagaaaaaauaguaaggaugaacaaaauuggaaugucaagugggagaagcuaauuuagagacaaaugacaguggaaacacuaauuucaguuuugcuuuauuagaguuuaagguguuuucaacuaaaaaaaugacccuauagguucuauaacuucucauauagaauuuuuaaaagaauggccuguuggaguuaggcagucaugaguuugaagauuggcucaccuauuuucugugugaccuuagauaaguuacuuguccuuuccuagccuucguuuuccccauuugucaaaugugaaauaauagaugauuguacuuaguauaggaucugaugcaaaguuagcauucagugaaugguagcuugguauuuaaauauauauuuuaugccccaguaacuugugaauuucuugcaaaucugagcauuuuuuuucuuucuagcuguuuuauuccccaacuguguuaauuccccauacuaguagucagagugauuuuguuaaacacugaucuugucaguuacuuccuugugcugaugccuuccacuuguccuugucuggguaugaauaucuuaggaagaaaccuugaugagguccucuguugaaaaggucuccuuucaaccuuuuuccuuucuaccauuuauaauuacuguagucauuuguuuaaucuuucucuuccccucucuguacuuaacugcuuguguauaacuauaaaauccaugaaggcuggcacaugguaagugcucaguaaguuuguuuaauagaucaucuuguuuuaaguuacuugaagacaaggacauuucauacuuaaauucugauaucuuaacauauugcuuucuauggcauaaguucuuaacagauauuuuugacucuaaguaaugguucgaaauaagcuauguagaauuauugggucaaauaagaugaagaguuuuaaaaauuauuuuagcauauuucuauuauaacaguaauacuucauaggaaauuuggaaaucauggaagaggcagaagaagaaaauguaagaguauugcaaagucucauggcagaugcuuucagauugcuuuccaaaaggguuuuauugguacauucuuuaucagcaguguuugagcaguccuauucuccaucuuuucagaauuuaaaaucuuuucaaaauuugaauuuucaaauucaaauuaaauuccucuauaauuugauagaggaaauugauaucuuacuuuaaucucauuuauugaucauuuuccauugaguuguaaugcugccuuuuucaucuuuaauucuuauauacuagguuagguuucugaacaaugcuguucauuaaucuuuuuauucuuauauuccuaccucaucuauuuuaacucccauaacuuuaaaaauauuucguauguggcaggacuaguccucuucauuaguuuugucuguggauuuuuauauauuuauuagaucucuuccucucucucucaguuuagggugaaaucaucccucauguccuuaacugcuuguguguaacuucuucucaauagacuaccuccuaccaaccucucucuuuccuuuuccugaaugcugauucucaccauaauucuauaacauaauauaaaggucucagucugcagaccugccaaaaugggaaaaauaaaggacaaucuauuauguauuuugcaucuaagcacauggguauguuguauguauauauguguauauguauauauuuauuacaucuguguguguguguguguguguguguaugcauguaugcauguuguuuaagguugccaacuggcauuucuugagaaggauugucauuguucugggauuauacccucaguagcccuauuuagcaagauguugguuccuagaauuguacuugaaacuuuuaccuaacuuguaaaaucuaaaaauaugggaaccauuacuuacauuucgcaccacaguaccuuucuuggugaugaugguauaguaaucauguuguuuuguccacugaaaaguguacaauggagucacagcuuauguaggaguuagguuuuuuuagcaucacuauguaauauagacauagcagcuagucagaauugccuuugcaaguuacuuguaaagugaugacaccauguuggagaugucuuucguaagucuggcauaacuuuuuucccucaagcacuggaacagaucacuguaucuuugcauugaaacaaagcaaagcaauuugcuuuuauuuaagggccauguuacauacaacuuacucaucuuuaaccauuagaaucacacuuuucauugagagguaugcgguuugagagcugaaaccaaaugagaugacuagagauuuacaucuugcaucucaugcucucuacaaggcucacuguggcuuagugguggcauguugguuugcagaaucuuuugcacuaauuguuuucuugguuuuguuuuugcuuuuguuuuuugagauagggucucgcucugucacccagguuggagugcaguggcaugaacuuggcucacuguagccucaaccuccuggguuccuccugccucagccucucaaguagcaaggaccacaggcaacaugccaccaugccuggcuaauuaaaaaaaaaaaauuuguugagacaggucucacuguguugcccaggcuagucucaaacuccugggcucucgcaauccuccugccuuggccucccaaagugcugaaauuacagguaugaguuacugcaccuggccuucucuucucuuucuaagcaucugcuucccccauccccuaccaaaaaaaauaucaugggacagggaagucuuagaagaugcuuagaaaauuuaagauggguaccauagcuugugucuguaguccuggcuacuugggagugugaggugggaggaucgcuugagccuagguguuccaaggugagcuauaaccauaccauggcacucuagucugggcuacagagccagaccuugugucauuuuuuuucuuuuggagacagagucucgcuuuguuguccaggcugaagugcagugguaccaucucggcucacugcaacguccgccuccccaguucaagugauucuugagccucagccacccaaguagcugagacuacagacgcaugccaccacacccaacuaauuuuuguauuuuuaguauagaugggccucccgucauuuuggccaggcuggucucgaacuccuggccucaggugauccgccugccucgaccucccaaagugcugggauuacuggcaugaggcacugcguccggcccagacccuguaucaaaaaaaaaaaaagaagaacuacuguagacucacaaaaaguugcaaauauacuacagagaaaucccaugugccuguugaacccagcuucccccaguaguaauaucuuacauaucugaaguuaucuaaacuaggaaauugacauuggcauaauacagucaacuagauaauagaucuuaacucagauuucacguacucauuucaguuuuuacaugcacucauuuuucauuuucuuguaugucuguguguauaauucuaauuauuaaaacaaauacuuuuaggcuggacccaguggcucacaccuauaaucccagcacuuugggaggcugaggcagcaggauugcuugagcccagaaguucaagaacagccugggcaacauagggaggcccugucucuacaaaaauauuuaaaaauuagccgggcuuugaggcaugcaccuguagucccacuuacgaggcugaggcaggagguucacuugagcccgggagguugaggcugcagugaagccaugaucaugccacugcacuccagccugggugacagagugagacccuaucucaaaaaacaaacaugcagugagccaugaucaugccacugcacugcagccugggcaauagagcaagacccuaucuuuaaaaaaauaauaauaauaauuuaaaacauaauuuuaaguuuacaggaaaguugcaaagacaauacagagaguucccauacagccuucacccacuguccccuguuguugacaucuugcaauguuguugacaucuugcaauuuguauguuuguuacagcuaaggagccagcauuggcacacuaccauucaacuccacauuuuauuuggauuuuacuaguuuucuccuagugucuuuuuucaguuucugaaucagccagguuaccauauuaaacuuagucauuauuucuccuuagguucaucuauacuguggcaguuuuucacauuuuccuuguuuuugauaauuuuugacaacuuugaagaagguggucacucauuucauagaauguccaugaauuugguuuugucugaugguuuucucaggguuaggcugggguuauaggcuacugagaagaucacagaggugacgaagugcaguuuuuaucacagaucauggauacaugcagucaguaugauguaucccuguugacguugacuguagucaccuagagagguaguguuggccagguuuucuacuaugaaguuacucugucccuccccuuuuuauacucuuuggaacaagucacuaagugcaauuugcauucaaggugugggaggacuuaaaccuccuggagagggggacuaucugcaaaaauuauuugaauucuucuaacaggucuuuuuaaacuuuauggaaacagcaugaguaccaaaucagucuaauguaucuguucuuugcagggugggaaaccccguaaacaccggaaggaucggcuacaagauuuaauugauauaggcuuuggcuaugaugagacagauccauuuauugauaacucagaggcugugaguaauguaucuuuaauauagcagcaaauucauuguuuguaugggauaguagaagucaaggguaaaguaacuuaaauagugcagugaauguuuuuauuugugcuuuuuaaagccauguucacuacuuaaagauuucuuuacccuuuuuuuuuuuuuuaaagaauacugcagacugagaauuuuguaauuuuggguuugucuguggugaauuguuauuacauuguuaaaauagaccaaguuuuaucaaacuuuuuucuguaaaaggccacauaguauuuuagacuuugugaacccugugguuucugucacaacuacacaaguuugccauuguagcaugagagcagccauagauaauaccuaaagaauuagcauggcugcguuacaaugaaacuuuaucuauggucugugaaauuuaaauuucauauaauuuuucguguguugugaaauauuaauuucuuuugauuuuuuuuccaauaauuuuuaaaauguaaaauccauuucuagcuugcaagcuguuugaaaacaagccggugggcuggauuuggccagugcaucucaugguuugcugacucuguacaaugucuuuauuuucauaugcucugcuccuuuccaguuccugaaagaaucucuugggauucucuaguaguugcucauuuucagaagucuaauuauagcguugacuccauccucaccccuugcucaaacagaacaaaaauaaguuucuuaaaaaaaaagagaaaaaggaaaaucaaaugcugaaaaacauuaaguuaagcuagugguucucaaucaagggugagaauauuaguacacuugucuuaacucagacuuaaggaauuaggauuucuggaggugaggccuacagagauuuuaguguucuuuuuuuuuaauuauaagauuaacauaugcuuaugguaaaacaacaauaaaguacaaggugguuauguagaagguaaaguacccaaaggccccaguccugagagguaaauacuaaaaaucuucuuguguaguuguccagaaauuucagugauacuuauauauuaguacauggauauaauccuuuuaauggcugcuagugaauauaccuaaauuacauaauguauuuaucuacacccauuugauguacaucuaaacuguuucugguuuuaugugcauacaaauaacggagcaucugggugcauuuaucuacugaaguaacuguguaugaaaucugggugcauuuaucuacugaaguaacuguguaugaaggguauuuagagggugcauuuauauggguagguuaaauuucuagcaguggaauuuauuggucaaagggcauuuauuugcaucgugauuuuuauugauauucccaaacuugggcagguguguuucaaaaugacuuccaagauaagaaccaugcaaucuuaaagauuggugcuacuggguugaaauuaaucuggcagacaucucuaauaucuguucaauucuuuauugcugccaugccuuauuaccaggaugguacauugagugccagucuuuaucaccagucuguuuugauugagcccuacagcuuuuccccuggaauccccuuuuucuuacaaaaggaaaaggaauuuaggagagcauuuaaggacuguagcagccccuugaucacauaacaaaugaaagacaagucauguuuugcaguagagaagguguauguucuuccauucuuguccauguacuagaguaaucuaaucccugggauuaugauauccucugcaaugugcaguaauuaagcauauacagaaggugacacuaggugacuauuacacuacccacaaauuauauauuaugucuuuuuuccuguugcuacagugcuugcuuauaaaguugaugacagaacauauaaagguaggagagugacaguaaggacuucaacaugaggcacauuggauauucugucaaacuccuaaguuaauucugcugucacggccgggugcgguggcucacgccuguaaucccagcacuuugggaggcagaggccggcagaucacgaggucaggagaucgagaccauccuggcuaacacagugaaaucccaucucuacuaaaaauacaaaaaauuagccgggcgugguggcgggcgccuguagucccagcuacucgggaggcugaggcaggagaauggcuugaacccgggaggcggagcuugcagugagccgagaucgcgccacuguacuccagccugggcaacagagugagacuccgucucaaaaaaaacaaaaaaaaaauucugcugucccgacauaaacuuauuuaccauacuaggcagucuggucuguagaaguaacauauugccagugcccuuuggaguaaaauggccuucgucuuacaaaaaagguugucaaccaauaaaucagggcauggaauguuuuccggagucuugaccucgauuuguaacuuggugcagaagucuagauuguaaucuuaauucaguuucuaauuugcuguguagccaggagcaagucuuuuagcaccacccgguuuucucugcuaugacuugcuuaccccacagaauuacugagccuuaaauaagguaaugaauguaaacuagcugaagaaacaugaagcaagugcaaagcaucaguagaaguguuauguguacauuuugaauucuaaauaacccaagaaguaacuuagccauauauaaaugggcaucacauguacucacacuuacauaaauagcuuuuuuaaauuaauaaacuuucuuuucuuagagcaguuuuagagucacagcaaaacugagcagaaaguacagaguuuccaugaacaccuugcccgcaugcacacacugccuucccccgcucagcaugcuguaccacaguaggacauuuguuagaguugaugagcccagacauugugacacaucauugucaccgaaguccauaguucacauuaggguucauucuugggguuguacacuuuguggguuuggacaaaugaauaaugacacguaucuaccaugguaguaucacacagaaguguaguuuugcuucccuuaaaaucuucugugcucugccuauucauuccuccuucccuccuaaucacuggcaccuacuggucuuaacugucuucagaguucuaccuuuuccagaaugucuuauagagaaaaucauauaguauguaacuuuuauaaauagcauuuuuaauaucuccuuuuauagcauuuaggauauuuucaugcugacuuuuguaacccauaauuggcuuauauaucaacuuaaagggcaugacugguauuuuuaaagaaaaugaaaucaaauagaauaggaacuaguacgucauugguagacuauacaguuuuuauuguguguguaugugugugcuagauuuugauggguaauguauuuuccacuugggcuguggugaagaaaaguggaaaacuucuguuuuaauaagucaggauaaauuuuguagauacgaauugcuuagucauacaacuaguuucugaacaagguagguuccuguuuuauaagaagaaauugaacugaaaugcagguugcgugacuuaacaaaauaacuuagugucuuugcccuugacauauuauuuguuuuuuuuuaaugagauaauucagacauaaaacaacuauggucgaaccaaaugauucuuguucuuuucauuuauuguauugccaguaagcuuucaguguuggcauauuguuuaauauauucugaaucaugcacgaauuacuaaaaauaaauaccugaaaauaaaugcuuuugaagauuauuuuuagucucauauuuaugcuaccaaacuguaaaagagcugaaagaaaauguuuuguuuauuauuaauaaauaaugauaccaggcaugauucacacacuuuuauuuagauagucucuuuuaaauuucacuagaacuuugugaaguaauauugucccuguuuuauaacccuccaaauuugauguuaagugauuuucccugggucacaguagcuagucauaggcaaagaaucuaaauccaggccuuuugauucuuaaguucaguguguuaccucuuaacacauucuacugaaaugacugaacuaaauauucacaaagaguguauuccucugaagaguguucggauaggaaaagcucagcagaauacugcauaagaaaacagacuuugagcacaucagaauugcccuguauaccuggagaugaacauguuucacucccacgugaagcugcuuggaagaaaaaggaauaguagcagugauccuuaaauuuuucuuagcaggugauauauuuagaauuuacuuuauuauuucagaaguuuuuuucuuacaccaaauuaucagaacuaauuuuuauuucagauaguaaccuuuucuaaauuuauuuuacaauaaauuagauggguuggaggcagccacugacuuugccauaaacauauguauagaauugcuuugguaaggugcuuaccuggcuuucaucuuuaaagugggaguaauauuugccuuucuuaccucacaaggguaucaugaggaccaaaugaaauaauuuauaugaagaaguauugaaaauuauaaagcauuguacaaaacaauguaggcaaagaguacagguguuuuuaucuuaucacaguuaguuuucgaaauuauuacugucuuuucacauuuaaucccucaccccucauaucacuuauuugcagaugguacugccccuuuucuguaagaucuuuauaauaguguagauguuuguaguagaucuuucuaguaguguaucaaguagaacgauaagaaaguaguuuuuuucuuuuaccuuucuucaaucauuuuauuucuuuuuaauucagugugauuaaacuggaaccucuucauuuuuccauucuccauauaauugaaaaagauacagguuaaaauuacaacuuuuguacuuagccuuauauucuuacaguaacuaauaggauauguauauuccuugcccauggcaaugaaguuucccuaaaaaucugacuuucuuaaagacuaguuagaugaugugaagaaccucggaaguagaggucuagagaucccagguaacagauaucuuucuacaaucagauaaguuccuuuuuucuuuccuacuuugaacaccuucauuugguuaaguuguccuucacuuaguguuugcuuuuuagccaucuuuaucaggugagguaaugauaaaccuugagaucuagccuuugggaacauaagugugauuuaaacaaauugaguuccuugcuccaagcaaaguaccuccucauucuagguccucaaguaugugcuuucugaacugggcaguuguuuuucuaugcuauucaauucuuuuaaaauaugugcuauucuuuuucuaaaauauauuugcuauuuuucuuucuuuuucucuuucuuuugagacagagucucgcugugucacccagucuggagugcagugguaugaucuuggcucacugcacccuccaccucccagguucaagcgauucuccugccucagccucccaaguagcugggacuauaggcacccaccccaccacgcccggcuaauuuuuuguguguguauuuuuaguagagaugggguuucacuauguuggccaggcuggucuugaacuccugaccucaugauccaccugccuuggccucccaaagugcugagauuauaggcgugagccaccaugcccggccuaaauuaaauguuuuuaaaguuuucuccacuuaaaagcauacggcuaagacagaaaaaauaguuucuguuaaacagaauguuguugcuguuuuuuguuuuuuuagaccgaguuucacucuugugcaaugacgcaaucuuggcucacugcaaccuccaccaccuggguucaagggauucuccugucucagccuccugagucgcugggcuuacuacgcccagcuaauuuuugguauuuucagucgagacaggauuucaccauguuggccaggcuggucucgaacuccugaccccaggugauccacccgccucagccucccaacugggauuauaggcgugagccaccgcacccagccaguuuuguuauucuuuauaaaaucuccuuaugguaggaaaugaaauuuacuccuuaucuggacacuuggucaucuuuuuaaacuugauuucucaucagaaccauuugucauuaagaauaguagcagugggaaggaagaaaaaggaauaguagcagugauccuuaaauuuuucuuagcaggugauauauuuagaauauacuuuauuauuucagaaguuuuuuucuuacaccaaauuaucagaacuaauuuuuauuucagauaguaaccuuuucuaaauuuauuuuacaaacauccuuauugcagucuguguugcaguuaggauuuaagggagaugcugccaugguggaugaauuucuuugacauuuauagaguuaaagacaacaggauauagcggaaacuuuuuuguuuuuuaaucuaguaugaugaauuaguucccgcuucucuaacaacaaaauauggaggcuuuuauaucaacacuggcacucuacaguuucgccaagcuucagauacugaagaagaugauauuacagacaaccaaaagcacaagccacccaaggugaguuuaucaaacauugcaacaguacugagaauguucaauuaauaggauuuuuuuuaauguuacuugugucacacgugugaauguaaggaaaaguaaaauacaaaccauugugucaugaauauauaauuacaugcuuuaaaauuaaauuauguagauauuggaaaauugguauuuacaucauagaauuauauuuucuuauaaaaacuucucucuacaaaugugggcuaauaauuuacuguuucugggagaagguuauauuucucggauagguuaauauuaauagcuguuaccuuuccuaagaugucauuuuuaacaaaaucuauagaauuuguauacauugucuuugggaaagauauaguguccuuggauaaguguuucuugaaguguggcccaaagacuuacuuacaccagaaucaccagaaugcuuguuuaaaaugcaaauuauaagguucuaacucagauaacugaaucgaaaccggaggugagagugcucuugaaccccaaggaucugcaguuauaacaaacgauuguaaugcacacugacauuugagaaaaaccacugcugaugcuggauugcuaacaucaaagaguaaagcauuguuacuuacauaaaugaucauucuuuuaucauuuugcagguccccaaaauaaaagaagaugauauugagaugaagaagcggaagcggaaagaggaaggggaaaaggagaagaagccaaggaaaaaaguucccaaacaacugggguacguuaaauuaaaccuaagaagggaacuggcgucacagucugacugucucucccuuuagaaagauauacuuaccauuaacuaauucaaccuagcugagucuaauuuaguacguuauugacauauuagugacuuauguuuaauaguauuguaguauuuguucuuaaguagaaggcuuugucaucuuagagacuccuaguguuuuaggugaaaugcucauuacuacuuuuaccaacaagaaccaguuugaaaagauauuauaaacauugaaaaaacuguucuaaucuuuugguacuaaaacuaaguuuagaugccuggggaaugaggauuggcaguagccuauauguaaacaauuuaugguuguuuuaauauuaaaaauuuugauuugauugauuugagacagagucucacuguaucacccaggcugaagugcagucccacaaucuaggcucacugcaacucccaucuccuggguucaagugauuguuaugccucagccucccaaguagcugggauuacagguguaugucaucacacccggcuaauuuuuguauuuuuaguagagaauauuuuaguagugaaacaugaggguuucaccauguuggccaggcuggucucaaacuccugaccucagguauucugccucccucagccucccaaagugcucggauuacagaugugagccacugcacccagccaaaauuuucauugauuuuacauagcuauucuuuuuuuuuuuucucuuuuagauagggucuugcuaugucacccaggcuggagugcacuggcacaaucauggcucacugcagccucaaccuccugggaucaagggauccuccugccucagcuaccugaguagcugggacuauaggcauguaccacuaugccuggcuaauuuuuauauuuuuguacagaugguguuucgccauguuaucuaggcuggucucgaacuccugggcucaagugauucaccagccucagccuccgaaagugcugagauuacaggcaugagccacugcacacagccaguauauagcuauuauuaaugauauugcugcuaaaaaacaaauagaauuucucagaagccuuacaucagaagaauaaaauauuuguauaaugcagucaaacauuaccaauugccuugacuucucuguggcuuuuuucacagagcuaagggaaagacgcuugugagaggcugaauuuucuuacucuacuuagcaguggaggugcaucugaauuuuggguuaucaauauccauaagauugaugucgggcguauuucuccccuccuaaaacuugggauuacagucauuaagaaauuaggaggaaaaauguguauauuacuaaugguugucuuaaaucuucauuauuuacaaguagacuucuuugggaauguaggcuauaaguaaucccuuuuauugaguguauuguuuuucaacuuuauaacuuauucauuuauucagcuaauauuuauuaaguacccugcuguauaccaggcacugauacaggguuuggguuguauaacagugacugaaacacggggcugccuuuaagaugcuaauaaccuuuuagguucuguagugcacauagaagcauuuaagccauaggauuuagaaaagauuucuaggaggaaguaauagcuaaacugagcuguuuccccauuuucuucacuguaauggccauuuaccuauuugccuuucgugggugacauuccagauuauacugaagaaggugcuauuguaauaguauaaguuaauaagaaauuaagaaaacugcucugucaccugucaaauuauuauuuuaauucugugccugcuuauuuaugugacacuuuaacguuuaaaaucacacauagccuaacugaucauuuuugucuucacagaguuguggcucuaaauucacacaagucugaaaaaaagaagaaacguuauaaagauucucuuucucuagcugccaugauuagaaaauuccagaaagagaaggaugcauuaaagaaggagucuaaccccaaagucccagugaccuugucaaccccuucucugaauaaacccccaugugcugcugcagcacuggggaaugacgucccggacuuaaaucugagcagcggugauccagaccuucccauuuuuguuagcacaaaugaacaugagcuguuucaggaagcugaaaaugcccuagagaugcuagaugauuuugacuucgacagauuacuggaugcugcuucugaugguagcccccuaucugagucggggggugaaaauggaaccaccacccagccaaccuacacuucucagguuaugcccaaagugguaccuacacucccagagggucuaccuguacuucuugaaaaacguaucgaagaccuucguguaguaaguguaauaauucucuugcuuuuuauuugcugcacaaacauaagaauuaaugcuuuuguucguuuguuuuuauuuuccacauaacacugguauaauugcuuuuguuuuuuaaagauaaaaauaauaaacuacaaucugaacauuuuuauaacuuuuuauuugccauguuuccuuuuagaccuuucuuuuuucuuucuuucuuucuuuuuuuuuuuuuuuuaguagagacgggguuucaccguguuagccaggauggucucaaucuccugaccuugugauccgccugccuuggccucccaaagugcugggauuacaggcgugagccaccgcaccugguguuuuauuuuauuuauuuauuuauuuauuuauuuugagacaaagccuugcuccgucgucacacaggcuggagugcaguggcgugcucugcucacugcaacuucugccuauuagguucaagagauucucuugccucagccucccaaauaucugggauuacaggugcgcaccaucucccccggcuaauuuuuguaugcuuaguagagaugggguuucccuauguuggccaggcuggucuugaauuccugaccucaagugaucugccugcuuugaccucccaaagugcugggauuacaggugugacccacugcgcccagccuagaccuuuucucuuaaauagaaauaacugacugggcaugguggcacaugcauguaaucccagcacuuugggaagccaaggugggugaaccacuugaggucaggaguuugagacuagccuggucaauauggugaaacccugucucuacuaaaaauacaaaaaaaaauuaggugggugugguggcgcgugccuguaaucccagcuacucagaggcugaggcaggagaauugcuugaaccugggaggcagagguuacagugagccgagauugcgccacugcacuccauccugggugacagagcaagacuccaucucaaaaaaaaaaaaaaaacccaaauaaauaaauagaaauaacuauagugauaacaucaauagaguugguucuuuuauuauuaaacagcgggauucaccugacuccagaguagguggcauagguuuuuuuguuauuccauguggccccaucucuacaaucuuaguuucuuuuagguuuuaaaaagugcuaaugauguaauucagguuuuucaagguguaauuauucauaauagcuaucguuuauuuagcaggaaccaauccuguguguuaguuccuuauuuauaagauagggacuguaacaccaacuuuuuuggcuguuacgaagguuaaacauggugaugagcaugaagucagacacaugguaggcaguaacguguauagaaaaugagacaucucuuucugucuccuuucuguuaccuugcaaaucacagcaagaauuaauaaaccuauggauaaucaaaauacacaagacauccgaaguauuugccucauuuugugaauuuaggaagacaaauuauauguauauauaucaaauaugaaagaaggguguguaugcuaaauuucaacacucuuuaauugccuacuuuaugccagguacuaaauugcauaccaaggauacaaaguuaagugaauuauagcccuacccucaaggagcuuauuuuuuaguaaauaaauaugggaacaguaucuuguuuuuuaaacuguggauugagacuuaucaguugguuggaaaucacaauaguagguaaaggccagcauuuuuaaaaaaugaaauaaaaauggucaggcacaguggcucacaccuguaaucccagcacuuugggaggccgaggugggcggaucaccugaggucgggaguuugagaccagccuagccaacauggugaaaccccaucucuacuaaaaauacaaaaauuagccccgcgugguggcaggcgccuguaaucccagcuaauugggaggcugaggugggagaauugcuugaacccgggagguggagguugcagugagcaugccacugcacuccagccugagcaaccaagcaagacuccaucucaaaaaaaaaaaaaaaaaauaggaauacgugcuaauacaucaaaaguagguuccaaaaguauuguaugacauuuuuguuuauauacaugugugacuacuggauaacuaaaucuaauuuucuauaacuaggucauauaaaaagucuuaagguuauaaaguuuaaaauuccaucagaaauucuucuagguguuuuuacucaaaggaaaucuauuuuuuauucacauuaggcuuugguaaguacuauaugcaucaugaagagauuauaacuuaauuugcaguuugauacuuuuuaugaccugugaugauuauugaaucuaaaaauaguacuaauuuauuauucacauuacuuuuuaaaaaauacuguuuuugccuucaccaaaucaucaguuaagugaccuuuuaaaaaaaucguuuauuucaacaguuguacuaucaauuccguauuacuuuacuuauucacuacauguuuggcuuuuuaacuuccucuuagagauuaccaacucuacugauuuuuuguuguuguugacuauaucuaugguuauuuuuuucccccaaaauauacugccuccagccacacauuucagcuggaucauugacuguauucuggucagcgauccucauggaauguagcuaacucuauuaauaauuaugaugucagugacuccuuaaaggacagagucauagagucugucuucuuggauucaaguuagauaugacaccagauucuuuugucugcucguagaagucugcaacuucaauguggggguugaucacacgauuuggaccucuuuuuuuugaccuacacuauuuuuguuuguuuguuuugaaauggagucuugcucuguccccagguuggagugcagugguacaaucucagcucacugcaaccuccaccucccugcaaccuccgccucccggguucaagcaauucuccugccucagccucccagguagcugggacuagaaggugcaugccaccacacccagcuaauuuuuguauuuuuaguagagacgggguuucaccauguucguuaggaugucuuggucucuugaccucaugauccacccgcuuggccugccaaagugcugggauuacaagugugagccaccaugccuggccuacacuauuuuuuaauuaauacauauaagauguagauauuuuugggguacaugucauaauuugauacauucauaugaucaaaucaugguaauuggguuagccaucaccuuaaauauuuaucuuuauaccaggaacauuugaauuauugucuucuagcuauuuugaaaugugccaucaauuauuuuuaacuguagcuacccuacugugaccuauacuauuucuaaauaucuuuguauuugauucuaaagacucuuaaucuugaugggaauugauuuuuuuguuuuuucauguucuuaggaucacaacuuuuacagauuuuuaaaauauuggccgggcgcaguggcccacaccuguaaucccagcacuuugggaggcugaggcaggagaucaagaccauccuggcuaacacgaugaaaucccgucucuacugaaaauacacaaaauuagccaggcguggugacacacaccuguagucccagcuacuugggaggcugaggcaggaggaucaccuaaacccgggagguggagauugcaguaagccgagaucgcgccacugcacuccagccugggcgacagaguaagacuccgucucaaaaaaaaagaaauuucuguauuaagccuuacaaaagauauccauauucuaauccuuggaaucugcgaauguuauuuuauauggcaaaagaaggguggaaucugugugugugugauuaaguuaaggaucuugagaugggguuguuauccuagauuagccuauggcccauaaaugcaaucacuuguaugcuuagaagagggaggcagaaggagguguuuuacacacacaggagaagguaaugugaagggagagccuagagggauuugagguuggaaugcugcggcuguguccaaagaaugcuggcagccaccagaagcuggaagaggcaaggaacaaggucuucccuagagccucuggagggaccaugggccugcugacaccuucauuucagcccggugauauugacuuuggacuuuggacugaggaaggauaaauuucucuuuuuucaagccaaaaaguuugugguaguuugcuauaauagcugcaggaaacuuacacaauacccagcugaauuugaaucucucaaauggcuuugccucucuguucaucacaacucauuugguguucuacuguuaggagauucuuuuuuuuuuuuucauuagauguucaucucaaaguaauuguuuauugcagcagggcacagugguacauaccuguaaucccagcuacuugggaagcuguaaggugggaggauugcuugagcccagaaguuugauaccaaccugggcaacauagagaggcccuaucucaaaaaaaaaaaaaaaaaaagaaaaaaaccuuugaacacguguccuaagaaugcaaaauagaguaauggccuauuuugauuuauuaucaucuuucuuguuucuuuaggcugccaaacuuuuugaugaagaaggaaggaaaaaauucuuuacacaggauaugaauaauauucuucuggaguaaguaauuuucuuuaaaaaaaaaaaccuuaagaaugauacauuaaaaaauguaauaggccuuugagauacugagugguuggcaagucuugggcaugaguucuuccccuuaagccuuacagcauguaugauucacauuuguuucucagcaaaauuaucuuucuguauauauugguuuuccuggaccacuuaggauaaucaaagcuuccaauaguuacaacugccagagcaagugacgacuaugcagguuggauauuaagcuagacuuaacguacuucauaccaccuuauaugaaaguaucuuucugggaaauguuagagcguuuauauacagauuuggcaugauuuuccaucuacuuuuauuacuuacacuggggaauaguaauuccguugauaucuagugagguugauuauaauuuguacaaacuuuuauagucaaauggaaaguacaguuuuauaaagaaauugugguugugagguaggauagagauaauguagaggagauagcaguuagauugagaauaagaaggugaagguagauauauaauauagauuguauuuaaauuagcaaauuuuauauuuaacuuagcaauaauuuugcacucagaguuugauacuaaugaagcuguagguucuaagguuguggucaaauaaacugaacuuauaaaccuuguccuugacuuagauuuuaaccauuguuuacaagaaucagguauauaauuggaugcagaacugggcaaaaaaguaaucaugaggaaaauagcaaauuuuagcccucucuggugaaaauaauguuugcuuauucuuaguggcuuaguagcaucauguauuauagaaagacacgggaaaggucaggcaugguggcucaugccuguaaucccaacacuuugggaggccaaggugggaggaucacuugagcugaggaauuugagaucagcuuggggaacauagugaaacuccauuucuauaaaauauacagaaaaauuagccaggugugguagugcacaccuaucaugucggcuacucaggaggcugaguugggaggauucauuaagccugggagauugagccugcagugaacuguguucaugccacuguaccccaaccugggugauagggugagacucugucuccaaaaaaaaaaaaagagagaaagagagaaggaaaagggaaauaaaaggaaaaggaaaguaauauuuauaauacuaugauuuccaucuuuuaaauacauaauggagacaguuucucaugagaugugaagaagggcugauugaucauugcuucugauaauguuuguaauuuauuacugucuauuauuuuggagugcuuaaaaauagacucagaaaauguauaacuuagucugccgcuaguaugguggcagaggaguuucucauuucuguuccuaguuacuuuaaccaggaauuuucagauggagucuuuucugcguggcagccaggcaacugcuuucuaucuacaccaccuccuuuuaccuagcucccuuuaaaaccccggacucagugaacagugcagccauuacuugucagagcugucccagauuccauagucagggaucugaccaacucuucuuuuucuuuccaccugggaacccgaagugugaucagguccuucucuugugacugaggcuguucuuuuuuauuuugcucuucuguaaaagggaacaacuguuucucuccggggagagucaaaagaccauccuugggacauagcaucucagauaagcagaguaucagcauuccauuaacaggcuuuccuguuuauuccucucaugucuaucuuaaaacgaaucuucccauuuuuuggagcccaucugcuuuuuauuucacagaggguaugccuccaguuucacaaguacuaguguucugaguugaauuuuuuuuuucccuuuuagucacuuucuuauucccucagccucuuuuuccgcuuuccuaaacaaacaugucuuauuuucuguauugaguugcccuucuaagagaauauggaacaugauuauuuagaguaggaacucccaugaagcuauccaguuguauuggugaugccuugccauugcuuccuuauacuagggaaaaaagagaucaauuuguuggaauagggaacccccccuuuuuuuccugauugaauuugacccggaucaauaaauauacaacaugcugaugauuuccuugccuacuaccuagagcagacguugcucauaaauguuuuuuucuuuuuucucuuuugagacagggugucacucuguugcccagccuggagcagugaugugcucauggcucacuggccuugaccugccgggcaauugccagugggccgagggguaguauaauaucucuuugaggaaaggagcuuuugguuaauuacaaauuuauugugcuuuacccaaaaccauagaguuugccccuguaacccaaaaaauauuuccagcuuguucaugguuauugaaguucuacucuuaaacuagauugauagaauacuuuuauagcauuacuauuuauugguauggggcugggcgcaguggcucacaccuguaaucccacacuuugggaucaaaggccaaggcggguggaucaucugaggucaggaguucgagaccagccugaccaacauggugaaaccccaucucuacuaaaaauacaaaaaacuuagcugggcaugguggcgggugccuguaauccuggcuaccugggaggcugagguaggagaaucacuugaacccaggagguggagguuccaguaagccgagacugcaccauugcacuccaaccugggcuacaagaacaaaacucugucucuaaauaaauaaauaaauaaacuguuuauugcuauggguuuuuuuuuauuuuuuccaugaagaauacuguuuaggaaaucaugaaaagauaaaaugagaacaagaacuggcuuugcuuucuugucugugcaaugccaccuaaaauaaauucuauacuguucauuguuguuaacuuuuuuggccagcauugaguuacagcuacaagaacuaggcccugucauucgcaguggugucuacucccaccuugaagcuuuugugccaugcaauaaagaaacacuaguaaaacgucugaagaaguuacaucucaauguccagguaagaggaagaacaauaauaucuacaucuuggguuucauaaccuguaaagauacuuguuucuguuuggggccuuugcacauuaauugauuuauagucauauuguauguauuuaauaaccauaggagguuauuaaaaguauguuggauccccugaaaaauaauugcgucuucaacaauuguuaaguuuagaugagaaauguuuucuacggcauagauuguuggauguaaguuaauauaguagguaugcucugacaaacaguauuuuuuaauauaaguacucaccuuuuuuuuuuuccuuuugauacggggucuugccccguugcccaggcuggagugccguggcgugaacauggcucucacugcagccuuaaccuccugggcucgagcaguccucccaccucagccucccaaguagcuaggacugcaggcuggcaucauuacccuggccauuuuuuaauuuuuuucuguagggacagggucucacuguguugccgaggcuggucuugaaucccuggcauguuugaaguuauuuaauaucccuuuggcuauggaagaaagauaucuuauccuuacuuuucuuuauaugguuuuaucacauauauuuguaucccuaaacauuauauuuaguuuugcauauuuuugagcuucauauauauaaagaaauacugucugcuuucuucugcagcuuguaaugcucaauauugugcaccugagauucaucuuaugucuacauauagcagaaauacuuuuuuuuuuuuuuuuuuugugacagagucucgcucagcccaggcuggagugcaguggcgcgaucucagcucacugcaaccaccaucucccagguucaagcaauucuccugucucagccucccgaguagcugugauuacaggcacccgccaucaugcccagcuaguuuccuauuuuaguaaagaugggguuucuccauguuggccaggcuggggucuugaucuccugaccucaggugauccgcccagcuuggccucccaaagugcuaggauuacaggcgugagccaccgugccuggccagaaacacauucauuuuuuacugcuggguacacaguguuccauugugugaauauaucccaauuaauuuguccauuuuacuacuuauggauauuuggguuguuuccaggcagguagccuaagcuaaauaauucuucaaaaguaaucaucuaggaaccaugauaccagauguucacuuuuuaauuuuuuuuuuuugagacagaguuucacuccuguugcccaggcuggagugcaguggcacgaucucggcucaccacaaccuccaccuccuggguucaagugacuauccugccucagccuccugaguagcugggauuacaggcaugugccaccacgcccagauaauuuuguauuuuuaguagagacgggauuucuccauguuuaguagagacaggguugguagagacaggguucuccauucuccaggcuggucucgaacucccgaccucaggugaucugccugccuuggccuccuaaaguacugggauuacaggcgugagccacugcgccuggccagauguucacauuuuuaaacauaggauuuugucauaugugcuauaauauuuauuuacugguguucguggaauagguuaauauacacauuuuuaaacaugggauuuuauguuauaugugcuguaauauuuacugguguucauggaauagguuaauaugcuuauuuguaauauuuguguuuuaaaaaucuuuuucuuuaccaaaaaucacauuuuaaaaacaguuguuuuggcugaguggcucacgccuguaauccgagcacuuugggaggccgaggcaggcagaucacuugaggccaggaguucgagaccagccuggccaacauggcaaaacccuguccuacuaaaaauagaaauauuuguugggugugguggcacacaccuguagucccagcuacucggguggcugaggcacgauaaucacuugaacccagaaggcggagguugcagugagccaagauggugccacugcacuccagccugugugacagcgagacucugucuccaaaaaaaaaaaaaaaauuguuucaguaaagaaaagucuuauaauauuucugcaccuaugauggugauaaaaguauguuuuaaguaguuacauauauacuuguaagaugcuuguaagaugaaaguaauaaauugguugauuaaaacugucagaugcaaaccuacuuucuuuuuugcccugaaaacgcacaugaauaagaguuuuuggguuccuuucacuuuggccuugaccuugcauuuuuacuugcagccuaagucaaaauuacuaaccauaacugagagaacaggauaccaacguccgguugguagucacccaaaccaaacacgugucuucguguuccagagcagugucuauucuuaggguacugguuucccaucacaauggaaauuaaccaguaguagucuauacaaguagaauacaaugauuuuguuuuccguuuucuguaugaaaguguucacggggcauuuugaagaguguaauggaacacuauuaauaauuaugcugggcgacagggaaaaacuggaacucuucuuggcuaacuggaauaugucauucuaauuuuguauccagugugucuuaggaaaagucagugcuguagaagaaauguccauauuuagauaugcuaauauuucaaaucuauaauugguaucuaaaacauaaauuuuaucuuuugaggaccugcuuacaagauuucguaaauaugucugauaaaaacuucuaguauguuuuucuuuuuaggaugaucguuuaagagaaccucugcaaaaacugaaacuggcuguuagcaaugucaugccugaacagcuauuuaaauaccaggaggacugccaggcucguagucaagcuaagugugccaaguauguaucucuucuauuuggacuggcuuuugcauuugagaaguguauguacguuauguauguauguauguauguauguauguauguauguauguauguauuuugagacggaaucucagucuguugcccaggcuggaguggaaugguacgauuucggcucaguacaaccuccgccucccggguucaagccauucuccugccucagccucacaaguagcugggauuacagacacgugccaccacaccaggcuaauuuuuguauuuuuaguagagacaggguuucaccauguugaccaggcuggucucaaacuccugaccucaggugauccagcugccucagccucccaaagugcugggauuacaggcgugggccacugcaccuggacgugcauuugagaaguacuuuuagcuguucugauguuaaguggaccucauucucaaguagaaauccacauauacugcugacuugauauaauugaguauuuuguaaauggcacucaguugcuuugcagucagagacaaaaggugucuguugauugauuguauggaggugaucaagcaagagcugacacuggugagagauuucacaaccccagcuugacugacugugguugaacacaaguguuuucugaccuaaaaggugaauguuggugccuuuacauuauaaucugaaguccuuauuuaccaaacuacuuuauaacuccuuucaaauuugaaguauuauguggaaagguagauuccgucuuuacccucucuuuuaacauuccauuaagcaauucagcaaguauuuauggagcauauuauauaggcaguguuggguuaaaaguuuguuuuguaaaguguuuuucauuuuuagauugcagacagaugaagaacgagaaaaaaauggaucugaagaggaugaugaugagaaaccaggaaaacgugucauaggaccaagaaagaaauuccacugggaugacacuaucagguaagauuuaauuaguuuucacuuuuaauauauaaugcagaaguaagauuccucauuaaaaaaaaaucuauaauaaauauaaaacuagauuggaagcaaccaaagauuaguguguaggaaaaaauuauucaagagaagauuaauugggcucuaauauccucagaguauuauugcuuuuauuuucauauacacuguaauacuuuuuacaaacuaaucuaauaaugguguaagucauacugguuucagaaggugaaguacuuucaacauauuucuucuuuagccaucuuucucaauaguauuucuauaccccaaguagagaaccaucccuuucaaucuuuggugcuuugauuaaagauaucaaaggaaauuguuucauauugcagguuugacuguggugcaaugaaugauauauguuagaaauuguuuguuauuuucugaauuuuucacauaaucuguauuauugcugccaaauguauguucuucuaaaaaaaguuucaaauuuaauuuucaaucuguuuagaacuuuguuauguaaccuuguugagaucaaauugggaugcuaugaguuagaaccaaauaaaagccagucugcugaagauuaucuuaagucuuuuauggagacagaagugaagccccuguggccuaagggcuggaugcaggcaagguaagaaaugugacuuacuggauuuuauuuuauuuuauuauuauugcuguuauuaaagauauacauacacauacacauaugugacauugauuuugcuaagaaccuaauauauucagcaugcugucuagucaucucagaugauccuugcuuugaaaaccuuaagcacuuaaaugacaaaacagucgcgcacacagagauagauguaaaggugauauuuuacuuaacauuuuuuuuaacacccaaauuugcuaguagagaaaaagagaagagggaagacucccaaaugguuaugaaguuugggagaggagcuuuauagggguaacaugaagaugaggaaccuaauaugggauuagagcauaggaaaagagacacagccuuagauucuauucaaaauagucaguguagaggccaggcacaguggcuuaugccuguaaucccagcacuuugggaggccaaggcagguggaucaccugaggucgggaguucaagaccagccugaccaacaugaagaaaccuugucucuacuaaaaauacaaaauuagccaggcgugguggcgcaugccuguuaucccagcuacuagggaggcugagacaggagaaucgcuugaaccccagagguggagguuguggugagccgagauugcaccauugcacuccagccugggcaacaagagcgaaacuccgucucaaaaaaaaaaaaaagaaaaagaaaaaagaaaauagucaguguaggccaggugcagugguucacaccuguaaucucagcacuuuggaaggccaaggugggaggaucacuuugagccccaggaaucugagaccagucucaaaaaauaaguaaauaaauaagaaaauauucaguguagagagauaucucaagaaacaaagagucgcucuguuuaaagucucaaggguuaagaauguggcccguugcgguggcucacaccuguaauagcagcacuuugggaggccgaggcugguggaucaccugagguccggaguucaagaccagccuggccagcauggugaaacccuguaucuacuaaaaauacaaaaauuagcugggcaugguggugggcaccuguaaucccagcuacccaggaggcugaggcaggaaaaucacuugaacccgggaggcagagguuacagugagccgagauugcaccauugcacuccaccugggcaacaagagcaaaacucugucucaaaaaaaaaaaaaaaaaaaaaagucgcugggcacgguggcucacgccuguaaucccagcacuuugggaggccaaggaggguggaucacgaggucaggagauugagaccauccuggcuaacacggugaaaccccgucucuacuaaaaauagaaaaaauuagccgggcaugguggcgggcaccuguagucccagcuacucgggaggcugaggcaggagaauggcgugaaccugggaggcggagguugcagugagcugagaucgugccacugcacuccagccugggugacagagcgagacucugucucaaaaaaaaaaaacgaguuaaguaaaaauuaauaaacuuggcuaguucaacccaugauuuuaauuaaauugcuccaucuucuaucaacagaaaagaucuguuggccaggugugguagcucaccccuauaaucucagcacuuuaggaggccaagggccacagugagaggauugcuugaggccagggauucaagaccagccugggcagcauagugagaccccugacucugcaaaaaguuuuaaaaauuagcugggcaugguggcacacaccuguaauuccagcuucuuugaaagcugaguugggaggaccauuugagcccaggaggccuagguuauagugagcuaugaauaaaacucuccauaaaauagauuauugaguauacuguaccauuauaacuuuuacuugguaaauaagcaguaauagucuacugaaaauuaaauuacuuuaaaaaauaaaacaauuauguuacuaucugcuauaaagaaaauaauaauuguguucuuuaaauuuuuccagaaugcuuuuuaaggaaagccggaguguucauaaucaucuuacuucugcuccgugaguaaaugcagacuccagauugcuucauuuauucacauuaugugcuuuagugaacaaaaguaucauuuauuaaaugcuaguuggaauaggacuuaaaaagaucauuuugaccauugacuauuuagacuucagaacacauuuaucuauugaaauaauugucaggguacucucuaaacaccuacuaaauccacacugugacacauaauggccugggauucugguaguagggaagcaugaaggcucagggauuuuccuuuguuccugggccuucuaccugccagucuuuuucuccaccucuuaauguccaucugcauuuguaaucuacagcccucuguguccugaguuuaccaggacagauccauaugcacacccacccucgcugcacugcagaguguuuuauuccacaaaauuaaccuauucuugaggucuucuguucaaaaccguguauuuccuuagugaugugauuacuagagaaagaucuuuuauccccuccacauacaacaaaaaggcaaguuuuuucuguggucaccuuuuugguugaauauuggucaauuccagaacaguuucauuuuucccuacaacguagggcuacuucucuguagccugcaaggguggcauuaacgguuauuaaagccaggcacaguggcucgcgccuguaaucccagcacuuugggaggcugaggcggguggaucgcuugagcccaggaguuugagacuggcccgggcaacauggcgaaacuccaucucuacaaaaacuauaaaaauuagccaggcauggugugugugccuguagucccagcuacucaggaggcugaggugggaggauggcuuaugccagagaggcggagguuguaguaaguggagaucaugccaccgcccuccagccugggggacagaacagaccuuguuuccagaaaaaaaaaagggggggguuauuaaaauauaaaauuagcaaguuacugagaauuuacugaacacucuaauucaauauucugcugagaggucuguuuaauaucuuuugggcaacauuauaaaauuccuacucuccuuguaugcaguuauauaggaauuuuuuaguuuuuaggaaggacaguucauuauuacgguugacccuuggaacaacacgggaguuagggauuucacccccucaucccacacagucagaaauccauguguaacuuucagcucucccagaacuucacugcuaguagucuacuguugaccugaagccuuacugauaacauaaauaguucaugaacacauuuuauauguuuuauguacaguauacuguauucuuacaauaaaguaagcuaaagaaaagaaaauguuaagaaaaucauaaggaagagaaauuauauuuacuauucauuagguugaagugaaucaucauaaaggucuucauccucaggggucaacuguauaucagagaugcauugaguugguugugguuuuugguucuguuuuuuuuaguauaaauucuaaguuguuugguuucauauauuacagguuuacuuuguugcaagaguuuuuguugucuuugaaauaaauuuuauguacauacguauauguuugugucagugguauuuucggcuuuaauuucccuauacaguagucccccuuauccucagacaauauacuccaagaugccugcaguggaugccaaaacugcagacaguacugaacccuacauagacuauuuuuuccuauacauacauuccuauaauagauuuuaguuuacaaauuaggcacaguaagagauuaacaacaauaauaaaagagaaccguuuaacaguauacuauaauaaaaguuaugugaaugugguuuaucucuauuucuggaauuuuccauuuaauauuuucagaccucaguugaccacaggcaacugaaaccguggaaauugaaaacuguggauaaggggggcuacuguaguucuaaagccauauauacauuacaauucagguacaaauaaugcauuccuuuaauucuaaagguguuuacaaaagaugucucccucucugucucucucuggcuuuuuuuuuuuuuuuuuugagauggagucuugcucugucgcccaggcuggaguucaguggcacgaucucaacucgcugcaacguccaucucccagguucaggcaauucuccugccucagccuccugaguagcugggacuacaggcgugcgccaccacgccuggcuaauguuuguauuuuuaguagagacaggguuucaccauguuggccaggcuggucucaaacuccuggccucacgugauccgccugccucagcccaaagugcuagcauuacaggcaugagccacugcacccagccuccuucucccuuuuuuuaaauagcuucauuauuaucauuaacuuuguguuuuguuuaacuuuguguuuuguuuuguaccagaaaguaggaaucuaugggauaagugggccuagaggucguuucccuaaauggccuucauaaaaaaaaaaaacauagaaaauuacuguugccuaaaugaaguuguaaauugacaguuuuaaucaagauucuuguuaaucuaauugaugacauuuuagccaagugaaauaggcaaggugaaguauuuuagcuugucaacaauuuaauuauucaacaaacauuugaauacuuugacuuacuauggaacuuguucuuuuuuuucaucuucaaacuuuuucuuaguuuuccaaaaguuucaagauuccauaguaauuuuucuugcccuuuuucucccugucauuuugacauuuuuuauuugaauuuuuacauuacaaaaauuuuucuuuaaaagcucaggguuuuuuuuguuuugguuaaguuaaaucucauucacaccuucuuggcaugguuuaauuugagccugcgguuccuugaagcucuuuuuuugggggggcuauuuuaugguuuauuuacauuuaauuuuuuaaaaauuguauuaucuacauuucauguuuuacuaguuguuuggccuuucaauuaaucugaauuggggaaaauguugcuacauacuucguauaaacugagcacuuaaauacgguuccuucaaagagcuuuccaaauagcagaaggaauuauuuaccacauaauuacaaagcuauauaacuuucuaaugagcaauauaacugcuacugaaauagccuuuuaaaaucuuuuuaucuuagggcaaagaaaaaggugauuccugcaccuaaacccaaaguaaagguaaguacugaaacaaaauauuuaauuaguuauaguuggugaauguugaaauacauuccuaagaugaaaaagauguaugguauuuagcagaggucaguaggcacuauaagauagauguuuucaacuucauaauaaucuuaguacuuuuguauuugggagaauagauuccuguguagcaguggggaauaugcauacaccaauugugaagcuuaacuuuauuaauacuuggaaaugcuagguaaaauacaacaaauauucuuucauagcauaggugagauugaaaaauauguaagaaaaauucauaagaccagaaacaaaaaaggagcugacaguguuaaucugucgcuuacacuuugguugcccuuggaggcauuuggcacuuucuacccaucacuuuaugguuucuuuuuacguuucuucucagagcauagcaguuaggguuuucuugggcuuguacagguuaaaacuugggaugaaaucuguguaaagcuggaccuucaaacaauaacaucuuuaguaaaagaaaggacuagaaagaaauccagcaaccagcagagacauuaaguggcugucuuggacuggguucugguuugggggaagaauguccuugcugaaaaauuuucuuggcuuaggaguuucaguuacacuaccucuacaaucugagaaaacgccaagcugaaaaaguagcuugguuacuggauuaguagugacccggggccacuggcaaaagcaaauucucuuugguauaacgugcccucuucagaggccucaaaggcauuccuccuauaaaccauggcagaccugagcuugcagucugaaauacagaauacaugagagaauaaguuacuaugagugagauucaguaggaacaauaaacagcaguuagaucccuaagacggacaaguagugcacuuauggaauuuaguacauaaaauaauuugacugaaaaauuuuuaauauuuagagaaauagaaaagggaauaaaaaauauccuaucaaaauagacaaaguagauuugaaagagaaucaaaauauaaccucuagaaguaaaaacuauaaucauuugaaauuaaaauuuuaaugaaagcucauacucuuuagguuuuacacuuugcuccauagccuuugucucuuugguuuuuguuguuguuguuguuuuuaauagaugagguucuuugcuuauaagauuguggccagauggucauuauauauuauucuguggccuuccugacuuuuuugguguuagagccucuuuaaaugcaggguaaauagucuucuuuuucuuuuucuuguuuuucuuuuggagacagagucucacucuaucacccaggcuggagugcaguggugcgaucucggcucacugcaaccucugccucacagguucaagcgauucuccugccucagccuccugaguagcugggacuacaggcgcacaccaccaugccuggcuaauuuuuauauuuuuagcagagacgggguuucaccauguuggucaggcugcucucuaacuccugaccucgugauccacccgccuuggccucccaaaguguugggauuacaggcaugcgccacuaugcccagccaguaguccucuuuuucuuaauagccuacuuugucuucugauccaaauaauauugagccaaucuuucauuaaaucuguugaauuuagauguuguuuugacacuugacuuuauuuuuauuagaauacuaaagucuuaguacccuccauaaaggauugguuacauuuugauacaucuauucaaacauaugauuaauagaauaauaggauaggaaauuuauuaaauucugauacugguuguguuaggaugauaugggggagucaucaguuuuuuuguauguuuccuucucuaugauuaaauuacuuuuucauuuucccaaaauggaaaagcuauacuguuaaugugguuuuuuucuacuguaacuccccauaguguuucuaguuauaaagauaagauaaggaaaugccuacaaaagaaaaugcaaauaacccggaaaaguaaggaggaaaguaaaaguaucuauaaauuucuccucagucagagaauaaaagcucuuagcuuucuaggacacaucuuccuucccuucuucugaaacucuguuccucccucccucccuuccauucguccguccauccauacauccauccaucuauccaaucagcuaucuauuuauuuagucuuuuauauaaaugggauaaccugcuuuuuugacucaguuauauauccugaacaauuuucucugccaguauaaaucugcacaguauucuauuagaguggauuuaaugguuuuauaaauaaaaauuaaucaaaaaguuauuuuaaaacagcaguuuuauacuaguaauacuuccaauauugggauacauuuccuacccuuuauuguguacuuuuuauaauggaauuuucacuaaucauguaaguggauggcauaucaaaacaaauguguuucaucugcauuacucauucuucuuagcagacauuugugaccuuaaugcaguuacacuuguacuuccaauugguagugagguuuuuaaucagggguuuuagaguaaaagcuuagaaaaaauacuaaggaaguuagaguguaacaguauucuuaacagcuugcuuauguaauaccuuaggaggugaugguaaagacccuuccucuccauucuuuccccacuaugcuuaagguaagugcuaugguuguaucaaucaguauguaauauaacacucuagguuuguuuggguuuguuuaagaaacuaauugaagagacuuugauacgacuuuuauguaauaggcuuuugcuucucagucuuaaaaauaaaaugagucaaauacuuuuaucuuuaaaaauaaauaguugcuuuuaaauuauuuugcucuuugaauauuauaaacugugcucuaguucuuuuucuuaaauauuaagaagguugauuauuugagaaacagacucuaacaacucuuagguauucagaguuguaauucuuaauacccuuguuuucuuagcauagagcccugcucacagcggacacuuaguggauauauauugaauaaaugacaaaugaguaauuuacaaauaaauuacagauucaccauaauaaauagcauaauuuauuuaugcuuggauugaaucgucugccacuuugacguaccaguuuuucuauguacuggcuguaggguagcugcaggacagggcauacaaagaggcagaaaugcauggaagcagaaagugaaggucagccuccuagcaaaccaucccagacgagaaggggagagucuuaauauaaaggcagaauuuauucugagugcaggggaauaaaaagagaauaaucugaacagauggauuuggagcaggauuugaagaucuaaugcaggugggggaggcucaucaguaauguaacuaguauaugaauguuccuuccacuugguguuaaguaugacagcuaugugcaauauaucagauacuuugucuugugaggacagcucagucaggagcucugucaucucaaaaauuauuuuuguuuugauagucucugaagauuuccaguagaaaaacaauuguaauugucaugagaaucuuuuaguuauuuaaaauuaacuuuguaauuuuuuauucaccauuucuauuuuuuuccauaugaugcuuuacauuaggaguguaguccaaaaaaggaccagaaaacuccaacaucccugguggcuucgguuagcgguccuccaacgagcuccagcacagcugccauugcugcagcuagcucuagcucugcaccagcccaagaaaccaucugccucgacgacucacuagaugaagaccuuucuuuccauucaccuucacuggaucuuguuucugaagcuuuagcgguuaucaacaaugggaacaagggcccuccaguuggcucaaggauaagcaugccaaccacaaagccucguccaggacugagagaagaaaaauuagcaaguaucaugaguaagcugccacuagcuacucccaaaaaacuagauucuacucagacuacacauucuucaagucuuauugcuggucacacagggccaguaccaaagaaaccccaggauuuagcucauacuggcaucucuucaggccuuauugcugguucuuccauucagaacccuaaaguuucuuuagaaccuuugccagccaggcuacuucaacaaggacuucagaggucaagccagauucacacuucuuccucuucacagacccaugucuccucuucuucccaagcccaaauugcugccucuucucaugcucugggaacauccgaggcccaagaugcuucuucguuaacacaaguaacaaaggugcaccagcauucagcuguccagcagaacuaugugucuccauuacaggccaccaucaguaaaucccagaccaaccccgucgugaaguuaaguaauaauccccaacucuccuguuccuccucacuuauuaagacuucagauaagccacuuauguaccgccuucccuuaucuacccccucaccuggaaaugguucucaagggucccacccccugguuucuaggacaguaccuagcaccacuaccuccaguaacuauuuagccaaggcuauggugucacagaucuccacgcaggguuucaaaucucccuucucgauggcugccuccccaaaacuugccgcaucucccaagccugccacaucuccuaaaccccugcccucgccuaagccuucugccucacccaagcccucucugucagcuaagccuucaguaucaacuaaacuuauuucuaaauccaacccaacucccaagccuacuguauccccaaguaguuccaguccaaaugcacuaguugcccaggguagccacuccagcacuaacagcccaguccauaaacagcccaguggaaugaacaucagcagacagucucccaccuugaauuuauugcccucuagucgcacuucaggccuuccaccuacaaaaaaucuucaggcccccucaaagcuaacaaacucaucauccacuggaacuguugggaagaacagcuugaguggaauugcaaugaauguaccugccagcagagguagcaaccuuaacucaagcggagcuaauaggacuagucugucugggggaacaggaaguggaacacagggugcuaccaaaccauugucuacuccacauagaccauccacugccucagggucuucagugguaacagccagugugcagguauguauguucuguacguccaugugauaaacuauaagauuguauaaugucgucuuucuuguggguaacuuuaauaagcuuuuuaugauauguggauuguucucaauuggcuuauuacagccugcagccauggaauguuccugaugcugacaucacagugacaggcacacuuguaguugagguguuuguugggauauggauuuuuuuuuuuuaaguaacaaaggugcaccagcauucagcugucugacagaacgaugucuucauuacaagcaaccaucacuaaaucaacuuuaaaauuauuugacaaaacaaaacuaaaauggcuuauuucaaacuuucucucuuaucaaaguccagaacaaaguaguaacuuaggaauuuaacgaacauucgcuuagcucuucccuucccuuuuucuccugccaauuuucuuauuuuucaaucaaauuuauacauucauguuauuuuuuaaaucauuuaucuucucgaaauuuuuauuuugcuuaauuuuguaguuauauauaauuuucuaugucaaauuagugucagucgcccuuuuauaccacaguuuucccguucgugaauuuuuaguuuaaacuuaccucucaauuagcugagugccucacucaagcaaucuuuucaagaaggguagccgggcaugguggcucgugucuguaauaccagcacuuugggaggccaaggcaggaggaucacuugaggucaggaguugcacuccagccugggugacagagcgaaacuucaucucaaaaaaaaaggguagcauaaaugcuauuuuaccuuagcucauguacaccugauaauuucuuucugugcugucacacuugaguaggcguagccuucuuggggcacuaacuguuccacucccaauuuuguaaauacuacuccacugacucuugcuuaguauuuaggauuauggagaagucugaggccauucucagacucuuucucauucucuuuuuguuccguuaucauuaauguguuuucucugccuaguugucauuaauuguauaccuagaacauaguaauagcuuuccaucucagaacugguuauuuauuuuagaucaagaauauuuuauuguauuaugugucugauuacuguuucugauccauuuaucguaaguuuuuugagaacucuuuauuauauauauauuuuuuauuuuucccuaagacagagucucgcucugucguccacgcuggagggcaguggcgcaaucuuggcucacugcaaccuccgcuucucggguucaggagauucuccugccuuaggcucccgaguagcuggaauuacaggcacccgccaccaugccuggcuaauuuuuguauauuuauuuauuauuauuauuauuuuuuugagacggagucuucucuguugccaggcuggagugcaaugacaugaucucggcucacugcaaccuccaccucccagguucaagcaguucucccugccucagcuuccugaauagcugggauuacaggcaugggccacaaugcccagcuaauuuuuguguuuuuaguagagacaguguauugccauguuggccaggcugaucuugaacuccugaccccaguugaucugcccaccucggccucccaaagugcugggcuuacaggcgugagcuaccacaccuggccuaauuuuuauauuuuuaguagagaugggguuuuaccauguugacugggcuggucucaaacuccuaaccucaagugaucugcccgcuuccgccucccaaaguccugggauuacaggcaugagucacugcgccgggccuauauuuuaucucucugucuuccauaucaucuucuguuauuguuuucaucucuaugccacuucuuuguauucugacacuuucucagauuuguccuuuauguuaaugauuuaguuucuuuaacuuuuuuccccugaaaguaauguauguucauugaaggcaaauuuagaaaaaagaaaauaaaaaucaccuauuaauccaauacuguuuaugcuuuguagguacuuuuuaagacuuuuuucaacaaaauguguuuuguauaauauuucguuuuauaaccggcaaaaaaaaaauaccauuuuaugauaugcaaguucuuagguucuuaaauauucuuugaaaacauaacuuuuauuuauuuauggaauuguguugucuaaggaagugcucuuuguacugucuccuauuuauguggaacaggaacauguaaugagaagaguuuccccuugcuguaugucaagguuuccugcuguucaauauagucuaaggguugauauucaauauacauuguauauucaaaucaucauucugcuacuaauguaggcauaggaaugacuggaugccagaauucuaaugaagaacaaauucagcuaacugguaauucauuaauugaaaucuaggauuaacugauguuuuauguauauacauuuacuuucaucagaaauaaaauaauaaaaacauugauacuagggauuauauguuaaaauguauauggagauggaugaauaaaggccuucccuuaugaaaaaaaagguauauggaagauuggaguuagucugcauuacuguuuauuaaauaguuuacucuucuuaaaauuaauucuuaauuugaucaaaggaauaagugaaaagauagcauaaaugguaguucccugccccguauccuccuccuaggguuaacuacuuuuaacucucucagcauuuucuucuuuuuguuuuuaaauaauaauaaauggaaaagucuugauuuuaucaauuuuauaaaaaauuggggaguuauuucuggaauuaaaaauucauuuuuauuuucauuugcuucauuuucuuugaacuuaagauuaaaucuuucuucauccuuugucaucucuacagucugucaguucuauuuuguucccagagaucuuccuguauuucauuauugauugcaaaagaaccccuauacugucuaacaaauaauugguuugucagcaugaaggcuacuuggcaaaguaugaguuucugaagacuaacuacucccuccugguuuucuuccucucccaaauggcuuuaugauuuggagacugaaguguuccugccuucauaucugaucuuuuuuuuuuuuuuuucugucuuacugguuugacugaagaaaagauuaauaauugaauaaggucauuucuacccuuuggcgaaaguaagguucuuuuuguuuuaacauagcgucucaauaaagucuuaccagcuaucuuguggccucuagaaccugucuauagcucuccaacacugaaaacagaguuccuaucuaugccuguaaagcauucaccuucugucugaaaggcaucugugggugucugcucauuugcagagugaaaaugacagguccuuuaacaaauggcaaaaguuaaacuccuucuggguucagguuguuagcucugcuugcuuucuguuuaauaacuuuccacacagggguuuccuccucuuucuuacccuucaacuuacugauuuucugugaauccugucuuugccacuuuauaauuccaaacaucauucauucauuaagcaaauguuuauugaguguuuacuaugugccaggcacucuucuaggugcuggggauauagggaugaacagcauacucacacauauagucuagguaggaagacaaggaaaaauacaaguuuuuucaaaaugugguaaaugcugugaaaaaauuguaggauaauaugauaaaagugauugcugcuaacguaaaaaagguuaagaagguuugaggagguaauguuugauuugagaauugaaugagcagaagccagccauguguagagaagagggggaaaauaguucaggccagagggaacaguuguaugaagacacugagauggaaaagagccugaagugaaggccugcauggcuggaccauggggagagagugguaggugaugagaucagagagagaccagaaccaugucauggaggaccuuguggaccacaguaaggacuuuggauuuuauucucugugcagugggaagcuauuggagguucuuaaacaggggacugauauggucugauuugcauuucaaaaguuuacucugggcguuguggggaauaggggaccagugcacucaccaaaguagaguaugugguuuaaaaaaaaauuuaauugcggccggucgugguggcucaugccuguaaacccaggacuuugggaggccgaggugagcggaucacgaggucaggagauugaggucauccuggccaacauggugaaaccccaucucuacuaaaaauacaaaaauuagcuggguaugguggcacgugccuguaaucucagcuacuugagaggcugaggcaggaggaucacuugaauccuggaguuggagguugcagugagccgagauugcaccacugcaguccagccuggcaacagagggagacgccaucucaaaaaaaaaaaaaaaaaaaauuaaugcccacuacgggaagagcaaggauucccuucaauguuuuuuccccugggaauaaaauguagaggucacggaaaguauuuuugauuauggggcauaaucuggaacuauuuaccugcuucaugcugacuucuugugcaugaucccagaugauaccaacauuggaguaccccacugcugaaaggucuccaucuuuuaggauagagagauuugcaaauacccaugucacauuuagauuaucugaugcuuccauuuauauuuauaaacaaauuaaaguggauauagaaguuacuugaaaguguaaaauguuagacaguuauggcauaguaucacuuuuuugcuauacuugaguuauuuaauuuuggaaauugcccucccuaauuuacauuuugcuuuuuuuuuuuuuuuugagacagggucucacucuguugcccaggcuggagugcaguggugcaaucuuggcucacugcagcuuccgccucuaggguucaagcagcucuccugccucagccuccaaguaccugggauuacaggcagacgccaccaugcccagcuaauuuuuguauuuuuaguagagacgguguuucaccauguuggccaggcuggucuugaaccccuggccucaggugauucacccaacucagccucccaaagugcugggauaauaggagugaaccaucgcaccuggcccucauuuugcaucuauuuuaaugcuucaauuacacuccuucagaaaagcuuuaaaagauuccuuuuauuaacaguauuuaauguuccucacuagggaacuccaacuggggcacacagccuuggagacucuuuaucaucccaagacugcaguagaauuaugauuagaagaagcaacucugguuaaauuuuuuuuuuuuuccgagacagagucuugcucuguugcccaggcuagagugcaguggcacaaucucggcucacugcaaccucugccucccagguucaagcgguucuccugccucagccuccugaguagcugggauuacaggcaugcgccaccacaccuggcuaauuuuuguauuguauuaauggauuaauuauuguaauuuuguauuuuuaguagagaccgggguuaguagagaccaccauguuggucaggcugguuucgaauuccugaucucaugauccgcccaccuuggccucccaaagugcugggauuacaggcaugagccaccgugccuugccaacucugguuaauuuuuaaguugaugcaggaucuuuucuuucccaguugcauuaagauacuauuauuucuaacuugguaauuuuuuccuaaauguacccauuuuauauauugugguuggcacaguacaggaaaagacaggcaaauaagaaaaacugucagguucaaacauggaguggugaagauuuguacuuaaguguaagagcaaauuuugguaaaaaagaaagaauggguuuguugacuauaauguuaucauuuuauaaugccugaaaacuaagguuucaggccuaagggacuggaaagaauggaauucccugaugaaagcaguugacagaagaugggggaacccauuggagaagaugauuucagcuuuggauaugucaaguuggugcuagauauucaaguggaauuauucucuuaacucucagauaugcaggauggaaauugagaugagaggccagaacuauggauauaaauuucaguuguaaaauuuguuauuuuuauuaacaaauaaaggagaacaggggagggaggcaguuaaagaaccaggaagaaggcugcuugcggauauucuucauuuguuuguugagcagugguguagccucuuaaguguauaaauauauguaauguuauguggcauguguguguggaaagauugucugcauuuuucuuauacauuaacuuaagaaguaccccaccagaagcaaaaggacaaagauuuuuaaaauaaucaguccuuaauuaauaaugcucauugauacauguaauaaaacuggaaagagcuaacauucauuaguuauuuuuaaaauagucaacaaauuccauuuuccugaucaaauuuagauuuagauggacacgguggcucacgcauguaaucccagcacuuugggaggcugaggcaggcggaucacuugagcacaggaguuugagaccauccuggccaacauggugaaaccccgucucuacuaaaaauacaaaaauuagcugggcgugguggugcacaccuguagucccagcuacucaggaggcugaggcaggagaauugcuugaacccaggagguggagguugcagugagccaagaucgcagcacuacacugcagccugggcaacagagugagacucugucucaaaaaaaaaaaaaaaaaaaaaacauggaaaacaaaaaaaauacaaauuuagaacuguuaaaguuuugaccaggaaaauuuggauuugguaaaauaaggcuacaaaagaaaucucagaaugacagaaacuauaauagauaauauaugauaaugagaaaauuuguaucaacucuguugauaaguaagugcacauggaaaagaaaaauguuggccaggcaugguggcuuaugccuauaaucucagugcuuuggaaggccuaggugugaggaucgcuggagcccagaaguuggaggcuagccugagcaacacagaccccaucucuacaaaaacauauugaaaaguuagcugggucugguggcacacgccugucuguagucccagcuacuugggaggcugaggugggaggaucacuugagcccaggaguuugagucugccaugagcuacaauuguuccacugcucucuagccuggguaacagagugaaaccccgucucuaaaaaaaauaauaauaaauuuuuuuuaaauaaaaaagucaaaauggaaaaaaaugauuuaauugccauguagaaaauuguucaaagaauuaaacuagcuauaggaauguauuugccaggcauucuggcucacacuauaauucuagcacuuugggaggccaacgcagugaggagaugguuugagcccagaaguucgagccuagccugggcaacauggugaaacccuaucucuauaauaaauacaaaaaauguuagccggguauaguggcaugugccuguagucuuagcuacucgggaggcugaggugagaggaucacuugagccuccaggagguugagauggcaguuagcugugauugcaccacugcacuccagcgugggcaacaggagacccugucucaaaaaaaagggggcggaguuugggcagggggaauauauuuaaguaaguucucugugaaagcccauccauguuggcauauuucuuauuuauuuuuuuaaaguccucccugcaguccaaauauguuagcguaucucugauuucaguguuuuuauucguaaacauggcaucaaagcccagguaggggagugugaaaacacuguccaauuugucuuuuaccucaaggaguguaauuucagaaaaguaauaaggugaaaacccgcuuucaggaguuagagacuagaacuaaggaaacugaagucugucauucuguuugauaauaaaaggaagacaaauuagauaguugcuaggaguuggggaagagcuagaauaacagugugguuauaaaaaaauaauaaguuucuguauaugagaaggcagaggaaacauggaaaaggugcaguacuagauauuuauacaggaaaguucuacacggugagaauucaugguguaagucaagugguuagcuuuggagaagggcaggugaggcucauggcgaggaagaacaccuuggccucgucucucuaagcugaugugaugacaguaaaggauaccaagaaggacccugaaagcagcagucugcagcagccgcugcaggaaagaugaugagacaaauaguaaagugaguauuuucagagaccgagcugaaauugcauggaauuacuuacucaugguucagguguuugggcuaggaggcaaaaguggaggagugcgaguggaagguugggaauuaguagauugagagagugcguggguguucauguaagugccacuaaaauaacagcgucuaaggaaccuaccgugguaaugaagagccugucucacaacguuucugucagagcagauguaaggcacagucuugcaucugugaggauauuauagaaaauaaaucaauuuggguugcuuuauuucuuauguauuuugaccccugguuucugcacaguccacagcaggagcaucauuauuggcuaaugccucaccucugacucucaugacaucaccuuugucuguaacaaaucaaaaugugacuccuuuugggaugcuggguggccuuguuccagugaccaugcccuuccaguuucccuuggagauauuuggcuuuggaacggacacagcuggagugacaaccaccucgggaucuaccucagccgcuuuccaccauagccuaacucagaguaaguggggcucuucuauuugguugggcugucuagcuugacagaacaggaaaccucacaaauuuauucuaauuaagaguaguccaguuggaguuaaugaagauuauaguuuuuuuuuuuuuuuuuaagaaaugcaguuuauauauaguaagucaaauuauuggacacugggguuuuauauacaguuuuuaagcuaucuauaccacauuuccaucuuaaugaaauuuuuaagaggaagucaguuguguuggguuaugugcauacacauacauuaacauaaguaaauuuucaaaaacgugcucuaguuuuagaaggccuucgaagucaggugcugugccugcauuacauaaaucaguuuucauuuuugaacuaaaagggcucaaaucuggauuuaaagaugacugacaagucuguuuuccucucagauuuacuaaaggguuuacagccaggaggagcucagcaugcagcaacgcuuucccacucaccucugccugcacacuuacagcaagcauuucacggugagaacgccaccuccuucaucucuuucuuauuuguauaggcuuauagauauggauuauacuuuucugaaaacaaugugaauggaaugacaaagguuggaaaaugcaaauuuucauagacugaauccucauuccucauuagcaacagauuccuuuuaagaggaaggaaauagguagaugagaucuguaacauauaaaaagagccuuuuugaagguguuuauuauguggaaaugacgacuaaucagaggauucauaagauaguuaaaaguuauguacaguaaugauaguaguuuacauuuauugaaagcuuacuaaaugccccagucuugugacagcuuacguggauuagcuaacuuaauccuuacagcaagccccugaaugauagaugacgaucuccauuuuaccaaucacgaaacugaaucagagagcuaagcaacuugcccaagauaauacacaacuugcccagauaacaaaugcuugaucugagauacaaacccaggaagucugacuccauggccuguauucuuagugauuaaaugucuuggcauuuuagcggagaugaaauuaauaugauccugccaggcacaguggcucacuccuguaaucccagcacuuugggaggccagggugggcaggucaccugagguugggaguuugagaccagccuggccaauauggugaaaccccgucucuauuaaaaauacaaaaguuagccaggccugauggcgcaugccuguagucccagcuacuugggaggcuggggcagaagauuugcuugaacccaggagguggagguugcggugagccgagaucacgccacugcacuccagccugugcaacagaguaagacuccgucucaaaaaaaaaauuaauaugauccaagcuguaugcauuauguccuuguaggcagccagaucgcucugaaaucugacauuaggcagucagauuaggcaaugugcauaacacacugggcuccagcuucucguuuuccccagcagucuaccuccauagacacugauauuauucugaagcccauuuucaggaucuuuugagcagaaauaacugcuuagcugcccucuuaacuuuggaaguugacuaggccucacuuuuuuuuuuuuuuuuggccacugcauuaaaaaugaccuuugaaccaguuuaccauuaaccacagugcagagaugggaacugaggggcaaucuugaggcaacagauugccauuaauccucugaaagaccuaaguggugagcugucucagucuuaaccuugagaaugaguauaaaaccacaguuguguaaaauggguaacacagagucguggcacaaaugucagcaaucccgaucuuccugaacucugacuaguuuaaauaucuaaagagaauuucccugugacuaaagcaugucccccccuggguguagacagcugcuugguauaaugaauccagcugaggguaguguacucaugggcagauuggcaugaauguggccaccugcaaggaauuaaacaagcaggauucuuguggcucaaaaagaccccaguguucgcucuuacacgaacuaucaaauuuaucugugcagcacugcuauuccgaggggagaaaggaaauaugacugucaguauuuuccaaauaacuaaaguuaaaaaguuuaaaauuuuucaaccaggcaugguagcucaugccuguaaucccagcauuuugggaggccaaggcaggcggauggcuugaguccaggaguucgagaccaaccuggucaacauggugaaacacuaucucuacaaaaaauacagaaaauuuucuggacauggugcugugcaccuguagucccagcuacccaggaggcugaggugggaggaucaccuacaccugggagguugaggcugcagugagcucugauugugccaccgcacuccagucugggugacagagugagagucugucccccccaaaaaaaaaaguuuaaaauuuuuccuuuaagaaacauuuuaaaguguaagucacugaacuugaggaucagacuuggauuuuugaauuccagaacugccaguuugaguaggcuuguuugaccaucacuuucucuugcuuguaaacuggagacaacaaauguuuuuuaaugacuucauaugagaaucuaauaaaaaauaauugauuuaaagcuucuagcuuggcaccuggugcauaguaagagcucaguuaauguugauuaauuuuauuuagucuaaaacaaaggucaguaaaauuuuucuauaaagggccaaauaguaaauauguuaggcuuugcaggucauauggucucugucaccacuacucaacugaccauuguagugaaaaacagccauaaggaguauuuaaacacaugaguaugacuguaaauaaaacuucaugugcaaaagcaggcagggaaucagauuuggccuaugggcuguaguuugccaaacccuggucaaauuuguuccuuuucaccuguguauuucugcuauucaugccucuucccucagaguaaaagguuuccuucuccuguccuuugcugucaggcauggguugucuuugaggccucauuuuucuugcuaaggccaugaccuguuggagacuuucuccauauucuguuggcuuuccaagucauugggccuuacccuugcccugguaucccccuuuccucuccuccuguccaguuuuuguagguaauuuaguugaggcuuaaaugaaguaaucaacauuuuuucugcaagcauuuaaacagcaguauguaaaaauagaaauuauuuugagcuggugugguggcacacaccuguagucccacuacuuagaaggcuaaggcaggagggucucuugagcccaggaauuugaggcuauagugugcuaugaucgcaccugugcauagccaguguacuccagccuggaaaacauagcaagacucucucuuaaaaaaagaaagagccaggcgugguggcucaugccuguaaucccagcacuuugggagguugaggcaggguggaucaugaggucaggaguuugagaccacccugaccaacauggugaaacccugucucuacuaaaaauacaaaaauuagccgggcaugguggugugcgccuguaaucccagcuacucgggaggcugagacaggagaauugcuugaaccugggaggcagagguugcagugagcugagaucgcgccauugcacuccagccugggcgacagagcgagacuccgucucaaaaaaaaaaaaaaaaaaggaaagagccuugucccaguagcagacuuuccugucacuuaaagcuagguuagaaugagcacacacucagcuggauguuuuucacuacagaugaaaaguuugcuacguuuguuuacacaaauaaucaggaauuaugaaaugcuguguccuggcaagaaauuuuauuucacuuacaaaaaaaaaaaaaugaaauugaccugucuuccaaaggaguugaaagauguagugggucccucggagguaggaauugugucuucugguuccuuuauaacccucucacagcauuugacacaauuggcugggacguaaaugauaaauacuuguugaaaucauauuuaaaaaacacugaaaaccacagucauuugagagaagaggaucauuguuguugaguuuuuaucuccaugauguuuuaucaaccucuauaaugcuauauggcaugcaagauauuaaaagugauaucuuuucagagaugucauccacaaaagauaaaaguuaauuguuguuuuugcuuuguuuuuguuagcugguuuuuguaacauauggacccauaccaauuuaacgucucuuuuucucagauggaggccaaaguaaaggggacacuaaauuaccacggaaaucucagugacugcccagcaagcaaaggagacgaaauguuuaguugacugauggaaucuaccugaugggaaaguacuuauguggucauagggcugcuguuucugucgauguuuacauucucucgucccaagcacuguggugaggaggaaaaagaaaagaaaacauuacuugagcaaagccaggugcaggaggaagaaaugcuuuugugcaaaguuagugaccuuuggucucuucuaaagaaugacagaguuaccguauuaacagacuugaaagagacucaguugucaaacccacagaaauacaaauuugauuuuucccgggggaggaagaaggaagugaagagaauuuggguaaacuccauccauccuggggguuggaucugaacacuuacagacauaauugguaauaaaaggcauuaaaaacuggaauuaggccaguuugucaggaauaaugaucaugucuauuugaauggacuguguagcagauuugccacaaaaagaaauaauaaugauucuaucuccgauagacaguagcugcauagcacacccucgaaaauccugaacaaacuugaaucuccuccaguguguagcaacuucccucaaucaguggacuaaagauccuucaggaaaguuauuuuagcacagugauauauauuauuaaaucaucuagauuuuuaaaaaucaggaaguugagccuguugcucuuaagagaugaaaccuagauguccccuuuuuguaaaagggucaauuucaucuuccguucagaagcagguacuuaacucuuuucuucaggugauuugugcaucuaguauugacugguuaauucuuauuuccauucuugauguuaaaaugugacuguguucacauuuuucuccugagaaauggggaucuuuacaggguuauugcuuugcugcuuuuagcccuugcagcaacauaaacucuaaguuuccccaguucaucuaacuucacaacuucuccuucuguucuuuuagcuagugguccuucaggugauuauuagcuauugguauaaacagguagaaguguacacuauguuucuucauuggucauucaaauggcaugaauauaguuuuugaauuuuuaagaugguauuuuaaagggaggaaucacauuaggaucacaaucacgacauauuuuuacucccuguauccaguguagugaaauuguuuggagcauuugagauccuaaagcuucacuauuuacucaguguauugguaugugaguaaaucugcagaaaauaagacuccuuaguuauuauagcuuccuuaugcaaauagcauauucaacaaaggauguuaagggaaaaauuuaugguucuccuuggauacauuugauuugauggguuuuuuugccgcauuauucuaguuuuuuaagcuucugaauauuuucauacuauaucagagaaugguguaaacucuaaaugguauaagcuucauccauuuauaaugacacuaaccuaaaaaaaauagacugguagugacaagauuuauugcauauguguuuauuauacauuacccuauaccauuagauuuacucaauuaagaguauuaaccaggcccuuuuuucuuuuauacacaaaagucccagauacccuacaggacugugaauaaauaaccacagaucgguucagaucuguaugccuauauuuugacuucaaagucacauuggcuugcuucauagcgaaaaaguuaauaaauaacugaaaacuuuaguuccaagaacuuguuacaguaaagggaaaggauuauuucaaaggaaucacugauauaauuucuugacucuaagaauuuaguuuaucaauaaaacaaauauggauguaguaugaaccccaguagauauuuuggaaggauacugggaggauguugcagagagguuugacuugaauucaguauguuugaugaagauuugcuugguuucaauuaaggaagcuugcccaauuuuuuuaauuuuuucaaauguaguggaccucuugcuuuuacgaaauaugaauaaaaaggucuuugcuucauacuaggggaagugaugggauuuuccuuugggaagguagccuuuguuuuacuucucauaccacaagagaagucgaagugcguauuaauuucucuuccugaauacuuguauauauguuugucuguauguauauauacauacacacauacauucauauaaaugacuaguuugagucaaaaaaucauuugaauuucuuaaaaccaucaauucugaaucaugccauaugaagaucccuggugacugucaucauuagaaaagaacaagauaaucaguucuuuucccuguaacauuuuauacuaaccaguaaaaauaucugaaggcccuuggcuccaagaauacaauguggagauucuucuguguucucuuuagucuugauuccuugaggacuacugucagaucccuaccuuaaacccccaccugcacugacgacuuacauucauuucagucaggaccccccuuuuauguuguaugaaucagucaaacaucguuguauuucuguauagauaaaguaugaucagagaguuucuacauguaaauaguaaucuauuucuuuccuagaucauaacauugaaaaaggugcccauacuuuauggucaccugucuuuaccguuuuuauuacuaaaaacaaacauauaaauugguuauuuuuuagcacagagacuugugacucauacuguauuuuugcacuuaaaaaucaaauuauguuauuuuuuaaaauggugagucauuggaaaggauaucuauagagcaacguguauuucugaagagcauuagcaacauccaaaugcaaaaauaaucagcacacaugauuauaucccacuccuugggauucuugauucaggaagauuaagcuguuuguuuucaacuguuuuauauuuuaaauugccuucacugauauauaagcuguuacuguacauacaaguuaauccucaguauucacaagcaauaacagucagcaggguuguccucggagauagcugugcugagccucaguuggagacugggagcaaagugucaagcucauucagagcauccagaauaaaugcaagcaauaauuuccauuauaauucaauuauaauucuuguaugcuuuugaggucagaggguaaaugaaaucgugauuuuaaaacagccugaagaaaaagguuuugggaaaggaaaugaggcuaaucuguagucauaaaauucugauacuuugcggaaauuagaagauggugauagugcauucuuuugugcccacccccccucugauggauguuguuagcccaaauuacauuuuucauaucauggacauugaauaggguuuauugaaucaggaagguaaggggaagaaccgggcacauauguguuggaauacuguggguuugacaccugguugaaaacaacuuauuggacaugauuuuuaacccaggauauuuuuuucccaaagcagaucuaaauuguuuacuacccaggguuggaaagggcaggcaccucuaaucuagucuuuguccucugguugcccucucccacaccccuuuccaccuauacuugguucaagacauuuucugaaacgaaaauucugcuguuguucaaacugccauugguuaugagaacucugcguccuuugggaucaucucuuagaacuccagugaucuaucauauuugcugcuacauuuguaaaaugaacuuugccuguauugguugacuuuaauuuacaguucuuuauuucuaggauguuuuguccucuaguuugacucauguauagaauuaggauacuuuauuuuaggaguguaccguaaaagcacacuggucccuuuguuguuuuuauuauuuagguuuggaauuuguuugcuuuuuuuuuguuuguuuuuuguuuuguuucuguuuuuguuuuuuuuuaaaguuggaaauagaagaaugagaaaaaucuauaaucaggccaaacuugagaacuuuccugugcuucagcacuguaauucugcugaccuaauguucucaaaagaggcacuuuuacuuucuauugugcauguaugauuguuguuuuuugcuuuugagggggcuuuuguguuuguaauaaugaagcagaagaaaagugcaguaguagauaaaugaucacaacauguuaugcaauuuuauuuuauaaaauuuuaaggggaaaaguuuaacucuuuguaaaucauuucuuagcucugguaaaaugcuuauauuacuccucuaaaacaugcucaauucaggccuuugucuuuguuaagugccuuuuuucuuucuuuuuuccucucuuuugaaacuguugucacauuaucuuaaaguacagacugauaagucaggggauucaggaggaagaaucucacacuugucaacaucaugucaugcuguguaacccucuuccuuugcuuucuauguauauggauauauguguaagauacauacauuacauauauauaaaacuaggagcugcuguaccauugcauccuuuccaaacacuccccuuuccauguuugcaaaacuucugccuuguuuauuccauugcuuuuaguugauuaaaguggguggauuagaaaaguaucuuuucggccgggugcgguggcucacgccuguaaucccagcucuuugggaggcugaggcagguggaucacgaggucaggagaucgagaccauccuggcuaauauggugaaaccccgucucuacuaaaaauacaaaaaauuagccaggcgugguggcaggcgccuguagucccagcuacuugggaggcugaggcaggagaaugacauaaacccgggaggcggaaguugcagugagcugagaucgcgccacugcacuccagccugggcgacagagcaagacuccgucucaaaaaaagaaaauaaaaguauagaaaaguaucuuuucacaagaggccaccuucgcccuuugaauaucugcuuguagaaguuaacaauaacaacacacacacacacacacacacacacgucaguuacuacaaguaaaauaaacuuagugaaucauugacuauucuuggauauaacccacuuuucugugcucuuuaaacuuggcauaaguaauauaggagacagcauuggaauaacaagaguaccuugcaagucacauugguaaggugcgcuagacuaaacaugugacaaggcuagcguuagaaccgcaguuuggugucuaaguuuagaagcagguuagcaacugucaacaugaaaaauguaucauauuuucuucuggaaaaugauuuuugaagaaaucauauagcugcauaucuaucuguuaaaagguuaauaaacucagaaguagaaagacuucagaugcugaggaaaacauauaaucuauagcauucuugagagauuuuccauuugcuuuuuauuugcuagauaauuacauuuggcuuaaucugauuuuaugguuauuuagauuucucccuugagcaaaauaacauaauuuucaguaucuaagauucaucgauuuuuuguugaaaacaaauagaugugacauguuaagggagaccaaguugaaccaucccucagacccaguacaaauauaccuaguaagugccccccuuucaauacauucuaauugggaagaagaagagacuaguggcuuaaaaggagaaagcagaagcuccugguaguguuaccugauagcagaacuuaccaggcaguuggaauucacgaguguuauucuugaaugacuaugucuagggggaauauuguuuaaccuucgugccucagauuacccauuagacaauuggguauaaucauauucaccuaccucccagggauaucagagacuuuacuauuucaaaaauauuuugaguuuuuguaaaauguccuauauaauuaaaaauaguauuaucaucuuccugcagaggcuaaaaaauguuuuccuuauaaugaguauaaaaagcacccuaugguuuuuaaauuuaaaaaaaucacuggaauuuuaauuuagauacauauuuguuauuuaaacauuaucuuugaggugggauaaaauguuuaguuucagguuaacaagggagagaaauaacacuaaguuuaaguaguuuuuuuuagccuuuuacgguguuacugugauuuuucgucaagguuguggagcuaaaguuagauaaaguuaugaugcuugguuauuggaguugauaaaugauccuggaaguuuuaacugucucacuuuuccaucuucucagucuaauuuccuuuuauugcuuguuugaggacggauagcuaagcuuuuuaacuuucuaagaaugaguaugaugucucauucuugcaaaucagagauuguguacuaauuccauuaacuguagguguauccagcucugcacugaaggggugagcacuacacacagucagcuggauacucuuguagccauugcaccuuuguaauucaugcuucuucaacccaugaaagagguggagccaucagcugcucagguuguaagaaaaugggagacggaaggcaggauucacuuucuaacugggucgggguggggaaggucaggguagaaggaaacauguuuuccccagcucccaggaggagacgaagaucauuuuaucccaccuuccaucccuguauauuaaguaguacuacuacauagaauuuucccguuaucguuuaaaauaauagcaacaggaaaagaaaaauggaugcugcaguuuuaguuggggcuaaaugcugagcaacgauuguuggaguguguguguaaauuuaaauuguagcacauauucagggucaggaaagcaaaauguuggggaugaggaaccaguguuaccagguucaagugaguuaguagaaagcaccagguccaagcagacaaagcaucugguuaauuuccagaauuggcuaagguccacugaaucucuaaugauagggugugugugugugugugugugugugugugugugucuguaagucacuuuuuggauuuuuguugcuuuuuccagauaaggccuuaguagccucuaaauaucaacuaugcagauaaacauacuccuuuuuuuuuucacaugucccugucuuuuccauucucagauaacaaauguuaagacccaaagaaauaaggcauaaggguuuuuguugaauguguguuuguucuucuagggaaaauuaacagaagcauaaaauagagauacuuuguguguucaucuaucguaaaaugugaacucuguauucaaaaacuaucuacagaugcuuucacuggugcaaagcuguaguuaguaucauggaaugucuuuggguuguuaaugauaaaaucaucccaguguucaauucugagaguuuuagauuauaugacacaauguucagguuuauagagcugaaugggugaucaaacucuaauuaaaaauagcuuugaauauuaauguugaauucuucuuucuugguuuccuuuagucuucauucuuuauucagagcucuuaaucauauugcuacacuagaauaugaauuguauauuaggagucuggggaggaaagguuaaauugucuuuuacauccucuucucacucacucuggcaaccuauccuguguccccauagaacugagaaguaaagcccugugcaggccugcuuuagaagacuuuacaucccagcagaggauucaggcagggacucucaggauuuuaaucagacugccuuugaauaaugugauauuaaauuuuauuuuucucauagacucucaaaguaccacuugcuugaaaguagcuacuugugaucuuuaauuuccuuauauugugauaguucuacuuuucagucuuuccuguguaucuccauuucauagugcguuaguacuuaaacuucggacacuuuuccaaacuguuaaacaagucaggaaugcuuuucagaaucgcaguaguauuauuagggucucugugucuaggacuuacagucaucaguggucaucacugggacuagagguguucuuuuuuuuccucuucuccuuuguauuaaaaaauagauuuugcuacuguauaaugcggcauuucaugacuuccucuuguuacuuuucaagguuauucuaaagagauggagaucuucauuagaggcuauuucucauaauagucugccuugcuuauuuucauacucccccugaaauaagccuacuuuugcaaacaggccauaugaaucaaauuuuauguuuguuccucacaaaauuuucuacacauuauuuguucccacuuugcuaauaauaauauaaugauuuuauuguaaaucuguguuuuaaauauuuuauaacagagcacuaauggaaaccuaauaaauacaaacaagauaacuauuacccaagauaacauggaaauacuucuguuuuugaaguuaacaacaccgucugcccucaaagcacauuuaggaguaucaaccaagaccagccaguugacauguuuuucuguguggcaaccugcccuuaaauugucagaucuuaacuaucuuguguuugcugugcuugcagccauaagcuuuccuccuuuuuugcuuaucccugcuguuuguaggguuagugugcccucugucagaaaauuggguuuucuuuacuauaccugcaaaauuaccaaggguuaccccaauauugucuagaggaauuaaaaagaacuuauucucaguugacaaaaguauuacuguuauacauaguuaauuggaaaguuggccaacuuuggucaccuauuuuugagucuuggcuaugccuuuguaauuaguuacauauaccuucugagaccuucagauaaucaaugggccuuuccccauuagagguagguucccagccuacaaguauuuccugugauccauggcaagccuccagagaaaagauucaagcuuugcacugcccuuuuguugauugucauugaaaacuuacuuuauuucagaaaguaucaaaaauaccaaauuggucuuucagagaguauguaaaucuggggcuugcccuuggauuucacuuguuaaacacccucaaacuuaaaagaagaaaauagaucuccagcuggugaaaauuuugugccccaaauaauauauuaauccaagucuaccaagguaacuaaguaauggauguuuucucucuuuuauuacaagcaagaaaguucauuugcaguuguaaaaaugauuaccgaacuccagaccuauuugcuauaacugauuggaaauaaugauucugauuuuuagucuggguaaacacauacuucggugugaauuuugauaagggaaagacuuguuugguagcccaaggaaaaacaggauguauuuauacagugaauguucacucugcagaggaacuucccuccaguuacaucuuccucauacauuagccaccuccacacuugacauagaugccaacauguuucaaaaccaaucuugaaggagccuaaagaguugaugguccucuaggugaaagacaagaauuacuguauugcauuugcuuauagggagguguguuuuugcuaacuugaagggauauacuguauuucaaauaagugugugacuuaauauuuugggauuuuuuuuuccuccuuuaaaaacuggaccugaacacaagcuuugaguugauguuuguaauaaucucaggaccugaaagauuguagcauuuagugugucuuaaaaauuauguacuguaccagccauggauuuuuguaaauauaccugucucccuuuuuuguauuuuaguaaaaaaaaaaaaaaauaaauuuaaauaaaaggggguggugaugacaugugaaugggugcggguaugugugcguguguguuuguauaaggcucuuuugagaugaacuggugcuuguuuaauuuccagcucaaaucggagcaggaauauggacaaacugcugcuacugaacccugcacugagccgagguauuuccauuugguuaacuaaacgcuagcuaccaggaaaugacgcagaagucacguucuucuucccacugccaucuugccuuugcauucucaguucuacgugcccuuugaacuuuaaugguaaaacauuucacacuuuggaugguuugcuugucucuaguuuuuagaaagcucuuaucacuccuuccuaagaaaaaagaagggcagguaaauuuuuuuaaccaaaaaaaaaucacacauuucauaaaacccugaugaauuuuggauaugugagagggcauaaacauuccuaaauauggaccugugaauuuaguaaauuacccccaugaauauacuccuucagugcagggauuuuuguguuuuuuuuuuuuuuuuaauuuuuuugcaacagccuugcucauauuccagguguagcuagcaaaccccuguuuuugaagcaagagccuuauuugauucaguguagauguuuccugucuauccuuugugacagggccuuuuaaugaguguuuuuucuuuuuguauauguuacguguuuguuguuguauuaaauaaagaggaauguacauacua

SEQ ID NO: 191599 - RNA, 4645 nt, Homo sapiens
agagguccugguaccuucaguuaacagucggguuucguuugauuuuguuacggcgccccugggccuucgauuaauaagguucggucaacggacaagugagcgguuccacugcucgucagucgauagggggagucgguagucuguccgaccguaccauuaggcgccugggccggaggagggguuuucagggucguaggacgccguugggcaccacgcucggagaaggacaggacaauggcggccuuaggguccccgucgcacacuuuucgaggacuucugcgggaguugcgcuaccugagcgcggccaccggccgacccuaucgcgacaccgcggccuaucgguaccuugugaaggcuuuccgugcacaucggguacgggagccaugucccgggugcucuacgugcuggggagggaggaagagccgggucugggcuaggguggggagcacgguguuuaauuccugcauuucugaggccaacccucccacggagcccugguucugaccaaaccaacccaggcccuaggcuccaugcucuggcauaaacucggggaccaaaggaccagcgggggggggcgcagagucgcucuggggacgucagccuguccugcagaggggcggacccgucccgaaggauuucauuggcuggucuguugccucugcggagggcagucaggaaaguggaauggaggauucaaugcuggggauaaaacaaugaagauggaguugaaggguguacuguugcuagacuuaaagccacagcaucuggccaacaauuuccucacccguccccuagaaaaguuauucuaagaagcauuucuuuuugaggcggaaaagaacaacugggcuuuagggaaggaaacuugcugcccuugagcaauguggggaaagggagaacgaucaacugucgaauuucugagccacggacgucagaauguaaaaucuuagaacucaaauucaccuaguuuuuaaaagguggcaacguuagggucugugcuaggaaccuggucuaaacaggaagaaucagaugcacauguguccuguccuuaagacacuugcugcccaccuaaggagccauacaguaaaguacugaggauaaauaagugcucaagguguagacaacaggggcugggguauaaagaagggguaguuagggaagguuuuccggaggaaauuaaucagggaccugaaggcuaauuuggaguuagcaaguaaauugggguuaggguccagguuuaaaagcuacacaauugaaagcccaaggggagaaaaauugccaguugagagugguuuagcccuaagguguggugggugaaguggagguagaugaagugguaggccgaacaggaacuuaaacuuuauuguaaguguaaugggaagccauucuaagauugugaucaccucccagguucaagcgauucuccugccucagccucccgaguaguacaggcaggcgacaugcgacaccacgcccggcuaauuuuguauuuuuaguggagacgggguuucuccauguuggucaggcuggucuugaacuccugaccucaggugauccgccugccucggccucccaaaguguuguaauuacaggcgugaacuaucaaaccuggccccauucuaagauuuuuaaggaggugacaugauuauaguuguaccuuauggggauaacauuauuacccuugagagagacuugguaaugguucugaaauucaugguacauucuggaaauaccacucuggaaugcacuugagcauaggggaaaugguuucuguuuccuucaggcucacagcuaacugaauaaccaucccauuuucucuauccuuucccuccggagaagggauucuauuagggagaaaccuacccuuucuccacagggaaaauacaguguucuauuucauuugaucucuuuuggguucuugugaucuauuuacuguuuccugucuauugcugacccuuuuguccucaugauucaggcucaaccgaaucaagagcaguauucuauccuacauuaaccuagaauucccaugucaaauuccacaaauuugggcuuauauauuaauagaaguggaugcuaugauuuguuaaugcuugacauugguguugauuucucauaaaauuuaaauuacuaaaaaguuaaauuuguauuaaagcagauuaauucuguuuuuaagcagcuaaugaauguugcuuucaacaugaucugcagauccuaaaacccacauucuaacagcaugggcaacauaguguagugagacuuccucuccaaaaaauuugaaaauuauccaggcgugauggcccauccucuaguuccagcuaauugggaagcugaggugagaggaucacuugagcccaagaagucgaucaaggcugcagugagccauguucauaccacugcucuccagcauaggccacggagcgagacccugucucaaaaaccaagaagccacacacauucuaguuuucagauucuaacacuagauauucaaauagagaaaggggauuaggccaggagcgguggcucacaccuguaaucccagcacucugggaggaggcggcagguggaucgcuugugcccaggaguucacgaccagccugggcaacauggugaaacccuguuuguauaaaaaauacaaaaauuagccggauaugguggugugcgucuguagucccagcuacuugcggggcugaggcaggaggaucacuugagcuggggagaucagcagccauguucacgcuauugcacuccagccugggcaacaaagugagacccuguccccaaaaaaaaaaaaaaaaaaaagaguugguggggggcguauuauguaggcaguggugcccagauuuauccacauuuggacauggcuccuuuagucccucagagcuaugcacacauccccaucucaccuuuccugccccuuucucacagccuugaauacagaacuaguuaaagagggugcagugaaucucaaaaguuaaguaugaugaagaaaaaagguuuggaaucauuuggggacuuuggaauggauauggaauuucuagcuucuuaaagucaugaguccagaguuuucaagauggauaagcaaauuguaagagcgagaauagccauuccucaguaacuguggggacugguuccaggacaccccccacccccacucaggaauaccaaaauccauggaugcucaagucccugacauaaaaugcuguaguauuugcaauauaaccuaugcacauccuccuguauacuuugucaucucuagauuauaauaccuuaugcgguguaaaugcuauguaaaucguuguuauacuacauuguuuagggaauaaugacaaaacauauguuugguaagacaugauaauccuuuuauuuuuuucugaguauuuuuuaucacaaguugauugaauccaaagaugcagaacccauggauauggagggccaauuguaauaaguaauaugaacauaagcauacuaguuuuauacaugaaaccuucauuuguuacuauuuagcacaaagcuaucauuuuucagacaaaaguuuucaauuuucuuucuuuuuuuuuuuuuuuuuuuuuuguugagauggagucuccuucuguuacccagacuggagugcaguggcccgaucuuggcucacugcaagcuccgccuccuggguucacgccauucucccgccucagccuccugaguaguugguacuacaggcacccgccaccacacccggcuaauuuuuuuuuuuuuuuuuggauuuuuagcagagacaggguuucaccguguuagccaggauggucucgauccccugaccuugugaucugcccgccucggccucccaaagugcugggauuacaggugugagccaccgcgcccggccaaguuuucaauuuucauuguaaugaaagguauaugccacauuaaucaaagucacagaaauauaaauaaagcaguccuuuauuugcuugaaagggagaaaguucuacauaauauucuuuaggugacauuaaugaugagugaccuaauuauaauuuccauaucuaccauuaaccaaccucugagcaucucuggacuuuaguuuccucaucuguaaaauuaaggaauugaaacuagaugacuucuugcaguacugacugaauacagggacauucaaugcaacuccuuuuaaaaauccgaacuagaggucagcuuuacuaauaacuauagagugccucuauagauguauuaaguauacauguauauacauacaugucuguauuuccucugugcaauuuacuuucacucuagugaaugcuuauuuauuaaaucuuucucuguggaccuguaucucuagcuggguuaagaauuucugacuugcugcuucucuaggucaccagugaaaaguugugcagagcccaacaugagcuucauuuccaagcugccaccuaucucugccuccugcguagcauccggaaacauguggcccuacaucaggaauuucauggcaagggugagcgcucgguggaggagucugcuggcuuggugggucucaaguugccccaucagccuggagggaagggcugggagccaugaacauggagaauauccuuggaugcugcauucauaggagaauugaauaauuucuaucaauauguauuuaucauuaaauuuuuuuuaaguuuaa

SEQ ID NO: 191600 - RNA, 82098 nt, Homo sapiens
auguugguuacauauacuguuuuuauuuggguuuguugaaugagaauaaaaacaccccaguuucuucugcaggucgagcccuucucuauaacggucauuacaaacaacccugaaguggcuggaauauagucagcaaggggcccacaugaacagcucaucuggaaucuuugcaaguacguauuuauguccuuuggugccuugcacaguaaggcacuguuaaugacguaacagaauagaggaaaugcccacagcaaauaguucuagugacaauuuacuagacaaguuacaguuuaauaauggugguggugauuguuucuuucauuuuauuauuauuauuuuuuuacaauaaggguguagccuuuauacuccacacacacaaaauaaaacaagugcuuauuacgaaaagagucccugcccccacccccuagaacauccugaacauagcaauucaacagaacagaaaaaucaagacguuugauuucaaaauuucaauaaaaaagcaaaaguauguaaugcaacagcuguucaacuuccaacucuaaauaggcaccauuaaacaaaaaaccccaguauuuuaaauuucuccagcacacauuccaggaucaaugcucugaacuguaaucagcuaguaauucauaacgggaauacagccuuagaauggaagcuauauugcuucccugcccccuuucucuuacaauuggagaguguagguauuaagggauacaaagucagaggaagaauaauuaaaaagaaaaaugcccaaagcugcagcuguuuggacuaggaagacagcauuuuacaaacguucaaaaaaucccaaggcaaguaacacaauuuguucacuagcacucuuacuugaaagaauaaagagaucagcaucuuauuauauaaaacuguacuuucagaacuguauuacagguucaccagaaacuauggauguaguuuuaggcaucaucaaggaaaacagguucaguucagaucaaguuagauacuguacaucuagccuagcuggaucuggugucuggaucugcucacugucacccugaacagcugugaacuaaacaauaguacguaacuccguaggaagcuuaaggacugaagaaauguacacagcuaguuagaucuccccugcuucgcgcucuucagagcuccuccugucuucugaucugccauuagcacucucauaggaccgcuucuuaucuuuccgaucucugucacgaggugaucugucucuugaacuccugucucugucacaugaugcuaagucuuggucucugaaucuuucuuuugaggaucugaaaaauauuaauuugaggagcaaaauauguugggaaacccaaaaacccaaauuaaagaauaggauaaauauuaagcucuugauagcugaagauauauagacgaauauacccaugacagaggagucaguuuucugacaaauuacagagcacuaccauaguugauaagggcauuaaaacaagaagaugggugaaaaacaaauagcagagggucagaaggcuaaaauaauuucuuacaggcuacucucaucucagagacaacacagaguuucuccaauucauaaaagguauuuuaauauaaaaaauaauacauagauaacagcuuuaaaaagugaaagaaauguauuaucuaaauuuuaaauggcuuagaauaggggccagauggugacuaucugggguacugcagguccaugcaaucuuuguggcaguucuuuucuuuuuagaauguaaaaaccauccauagcuugcugguuguacaggcuaccggccagauuuggccuaucggcaacaguuugccaacaccugacuuagauaagagaacuacucaauuauuaauaugaauuuaaauaaccacuucuaaaaaucuacucauacugaguuagcuuauucaaccaacaaggggaaauaaaaaaagacaaagaugcucacacuaauaaaucuugauuagccauaacuguuuacuaccuucuccauucccauacccaacuucauuauaagaaagguaaauaauaaaucaaucggaaaaccaaacauauuauggaaucagaauaaacauggaaucuuccauacuuccaacaucuaaaauucaacaaauuacauuuauuugguucuuuacaggugacacagcacuuuuacauaauuaucucacucaacccauauucaaaauuaggaucugaggcacuaccaagaaccugaauaaguaauacuuucaggaaaauaaaaaauaugacuguucaguuuuagaaauauaguuaaggaggguuaaacaaaaaaugguucuaaaauaauguccacuuugaacauucuacuuaauguuuuaauaaacuuaaaaugauauaaaaagacugggcacggugacucacgccuguaaucccagcacuuugggaggccaaggcaggcagaucacuugaggucaggaguucaagaccagccuagccaacauagugaaacccccgucucuacuuaaaauacaaaaaauuagcugagagugguggcgugugccuguagucccagcuacucgggaggcugaggcaggagaaucacuugaaccugggaggcggaggcugcagugagcccagaucgcauuacugcacuccagccugggugacagagcaagacuccaucucaacaacaacaaaaaaucacagugccaagucuagugauuccacgucuacacuaguccuauccauagccuuuguuggaauaaaauaugaaaagagaugguaaaaaugauaccuaaaaagacacuagaugccaaacagucccagugaucaguaauaacuaaaaaacuaugaguaucaacuacuaugucccacacauagugguuuccauauacuauuuuacucaaacuaccaauaaucuuaacaaagcagguauucuuacuuucuccacuuaguagauggggaaagacaggugagauaguuauaaauuacuuagccaaggugggacgugguggcucaugccuguaaucccagcauuuugggaggccaaggcagguggaucaccugaggucgggaguuugagaccagcccggccaacauggcguaacccugucccuacuaaaaauacaaaaauagccaggugugguggccugggccuguaaucccagcuacuugggaggccgaggcaaaagaaucgcuugaacccgcaaggcagagguugcaacgagccgagaucgcgccacugcccuccagccugggugacagaacgagacucucgucucaaaaaaaaaaauaaauuacuuagccuaaaccaaugaacccaaguaaucugacuuuggagucugcacuaaacauguuugaacagagcaaaaagauagauagaugcaaaugguccucauuuacgcagggcacuauugccaggaagaggucacaaagaaucuacuuguaucagagacaaguauuucacaguagggaaaggagaacagcaaaacauaaaaggcuuucaauaagaacuuuuaccuugaaaaauuaaacccaaauauguagcaauaacuugauguuguaugaaauaccaaguagguuuuaacagcaauuaucugguaauuuuuaguauaaaacaaagaaugaugcuuuaaaagagaauaauuugaauucaaagaugagaaagugcucgagaaaagcaaaacuuuuaauaguuuuacaaaaauaauccucuuuaugaacaugcugacaucuuagauaugaucauguaucauguaugguggaaaaauuccuauacaacuucaucaacgcaggaagcaucagggacuaaaauaacacaaucucagauuaggggacuucacgcccauccuucccauacccaucaccaauaaagacauuuaggaguucagcaacaacaaugacaguugggcagauuugacacaggaaaaugucuaaaccuuccaucaccuagcaggauaauucugaaaauucauugugcagauaagacagguaacuuuuaaaaaaugcuuauuucugaacacugcacugaggguagacccccaaaaucaguuucaagagugugagauaagaggccuacaaaucacucuguccuuuacaaacucccuccucauucucugcauuugccuaggauauucacucuauauggaauaucuuuuuccuagcugauucuaccuguucaaauuuuaccgacuaccugaagccauuuuugauuacucuguuauuugccucaucuaaacucucggaucauuuauucuaugauaugcaguuuagcacuuuauaacaugugguagucuuaugccagucuaauuauugucaaagaugucaauccuuuguucuaacucacauaggagacuuuuuguuuuuuuuuuuguuuguuuuuuuuuguuuugagagcuggagucucgcucugucacccaggcuggagugcaguggugcgaucuuggcucacugcaaccuccaccuuuguguucaagcaauucuccuuccucagccuccugaguagcugggauuacaggcaugugccaccaugcccggcuaauguuuguauuuuaguagagaugggguugguuggccaggcuggucuugaacuccugaucucaagugauacgcccaucucggucucccaaagugcugggauuauaagcgugagccauggcacccagccucacauaggaaacuucuuagagcaacuuaaaguuguucaacuauguuauacgucuuucuuauguuuuacuaagucuaguacaguaaaacauauacaauuaauuauuauuaaaaucaccuuaagaaauacuaaaaacaaggccagaauauaagaaauaaaauauugagagccuauuaacaaacucagcuugugagugauuucagggaauggaaaguugagucaaaaaaaaauaggaaagauuuuaacagcuuucuguggauuuuauuauagauuuuauguggaguaauccacagaauauguaagacuaguagguacuaggcacucaaaaaauguuuaucauacauauacuucugaauaguugucaagaaaaaagcaauuuuaaacauggcuuacguuacacagaaauuaccugguuuaagggccaucaugugaccugagaaguuuugacaguuugaucuauacagacuaugaaugcuaaacucuucuaccacauuauaauccuuugucuauccuuaauagauauucaaguccucaaacauaccuuacccuaugccugcaccuuuugaauguucucauuaaaccaagggaagucuuggaaccuccuuauuagucugccuugccaagcugaagguauguaacaauacauaucuauagugcagauaaaacaagaauauacuagaaugugucugcucugaaaaagcaucccagcucaaauaaguuuagaaaacaauaaaucaaagcuaaacaacucuuguaaugaaaggacuucucagagccccuaauuugcugauccauacuaaggguauugguauuuaaaauuauuuaccuguaaagaacuuuuuuccaagacacacuaagcagagaaaagcaauaaccucuacacauauugguuccaauuucuugcucuggcucauaaguauauucuuucaaaacuacccauauaaucacagaaaaauguuguacacccacacauaaauguguacauauuaccagaugcaaaaguuucaaaccaauaaucugaacucuaaacauaaguaacauaaguaaacauaaacaacucuaaaacauuaagguagcuccauauccucugauugacacaucaauaccuccucuuggaucguucucugcuccuaucucuagaacugugccgacuucucugguggcuacggcugcggcuacggcugcuggagcgggaccuguggcgauggcguuucucccgagauuuggaucgaguucuccucuugcguucacgugacauggagcgagaucgaugucugcgaugcucucuggaccuggaucuaccagacaagauuugauuuuguuucuaccuuuguaauuacuauauuucucauuuauuaaagccuuuucuuuaaagagaaacuuuuuuucaguagucuuaaugucaauuauauuccaagucagcuaaaucuacacugaauugcugguguguuaauaacuacauacuagaauucaaaauaaaacauuaauaauucucagccaggcgccguggcucacaccuguaaucccaacacuuugggagucugaggcaggaggaucgcuugagcucaggauuucaagaccagccuaggcaacauggcgaaacucugucucuauaaaacauacaaaaauuagcuggacacagaggcacaugccuguagucccagcuacucaggaagcugaggugagagaaucucuugagccagggaggucaaggcugcugcaaugaccuggugaucacaucgcugcaguccagccugggcaaaagagugaaauucugucucaaaaacaagacacugauugauaauucucagagagcaaucaguaauguauaaauuuauuaucagaaauaguuuuucaagugaaagcaacuuuugaaccacuacuauaugccaggggcuauauuaucuagauuuguuaugaauuuaauugcacuuaaauaucuugaacauuuuuguauccucuagaaauuaaauauguaccugacagaccuggacagaagggaagagaagagaugaggaagaauacgucaggacaaauuacucuuugucugaauuagaaaggugagauaaccauagaaguaaguuuuuaaugcccacaauaugcaugucuagucacaguguaaucaaaacagaguaagggccagggguaguagcucacgccuuuaaucccagcacuuugggaggcuaaggaaggaugaucacccaagcccaggaagucaaggcuacagggagcuguguucacaccacugcauuccagccugggcaauagagagcaagacaaaacaaacacaguaagacaguucucuauucaaggagcaaacaguuugggagaaagaacacuugcgaaaaucauuuuugagaacuugacucagauugcaaaaaaaauguauuucuaaugaauacacagaaauagagaacgaaaaacauucugaaaaaccagaaaauauacgaucaaggugcuggcaaaauaaagacauuuuuugaaaagaaaaaaacccacaagguaagacacuuuuauagccuccaccaggucacaaacuaacuuguggggugggugggggugcauggugaggguggaaauggcauggagaggacauaaacguuugacagaaaacaaggggaaacaaaggaaugcaacuuuguuagaagagucacuuuaagaaugauggaaauguucucaacuggauuauggugauaguugcacagcuuuaaaucugcuaaaaaaucacugacuucagaguaaaucauauauauauauauauauauauauauauauauauauauauauauauauauuuuauaccucaauaaaacucuuaaauuuaagucacuuuaagaaugugagguuugcucauaauuugauacagcaaguucaaaaucauauuauacauaugagauaguuuacaaauacaguuuaucuucaacugauuguuaugaacgaugcuaaaaggcauucagcuuaugucaacauuauagucaaagaaagguacaugacauggacguagcuuuagccacacuuaaaaagaguauuucuggcugggcacaauagcuugugucuguaaucccagcacuuggggaggccacaaugggaggacugcuuaauccuuaaacgggaggaguucaagaccagccugagcaacauagggagaccccguaucuacaauaaauuuuuaaaaauuagcuggacaugguggcacacgccuguggucccagcuacucaggacagagugagacccugucucaaaaaaaaaaaaaaaaaaaaagcguuauuuccacagcugaaaagaguaauuccaaaaggaagcagagggaaaaaauauaaaacucucaguguaaguuuuaucaaaucauacuucguuuaaccacucauuuugaguuauuaugaaugccauuucuuccaauguauaacuuuauucaucuuuuuaaaaauucuagguaauuuuuucauccaaaaaauauucacuagguauuuuugcacuguucuauacuaggggagguugaguagcaaguaaaacaaaguuccugcacuaaacuuagugcuuauacuauagaaagggaucuauacagguuuguaggcaguaaauaaagauaugucaggugguuaagaaaaaaaaaaaagaucuauugcuggacauggugacucaugccuguaaucccaacacuuuggaaggcugaggcaggcggaucacuugaggucaggaguucaagaccagccuggccaacauggugaaaccccuacucuacuaaaaauacaaaaaaaaaaaaaaaaaaaaaaaaaaaaacuuagcagggcaugguggcacgugccuauaauccuagcuacuagggagccuaagguagaagaaucacuugaaccugggaggcggagguugcagugagcuggcauuuugccacugcacuccagccugggcaacagagcaagacuccgucucaaaaaaaaauuaaaagauguuauuacguagaguggaaaaagagaaaagaguggaaauauuuauacggaauaagcagggaaggcuuuucugauagguuggcacugaagcaaagcugaaagaagaaagggaacaagugaaucagucaucucagagaggagugcuucaggcugagggaacacagaugcaaagucccugaggugggaaaaagcucagcauguugaaggaaaagaccaguguggcuggaaugaagugagcaaaaggaaguaauaucagggucuuacaggcaggaugaccagguacuuuaucauucaaacuagaaggcucugaauaaguuacugaauguaaugagaagcuauuaauacauauucugggauaaaagacauaaaccagaacuaucccagggcaguuugggcuaugccaagcuuguccaaccugcggccuccaagccgcaugcugcccaggauggcuuugaauacagcccaacacaaauuuguaaacuuucuuaaaauauuaugagauuucuuugcaauuuuuuuuccagcucaucaguuaucauuaguguaucugauguguggcccagguaagccaaaagauuggacaccccaggccacaccgucacccuauguaaaagcuuugguaaagauguuaacuucucauaugaaugagaugaaaaaccuuuggagaaucagagggcugaugugauguauuucauuuauuuaaaggcucauccuggcugacgugugaaaaauagaaugaggugaagaaggggggugggcaagcacagagaacuaaggagcccaguuacaaggcaaacauauuaucuagguaacaggacuagaggaauagaaauuaaauuucuggcccaaauaucuaaagauguucuaugugcaauacuuuauguuuucaacaaagggaccagcuuauauuaaucaaacaguaaacaauaacaguaucacaguuuaauguuucuacuuaucaugcuagaucagagaaauucaccaauaauauaaauuagcugacacaacuggccccacuuauuaauguucuuuaguuuuuuuaguguuuuaggcagaaauaucauugauagauguugcuaacagaacuguaagguuuuuguuuuucuuuuuuugagacagucuuacucugucacccaagcuggaaugcaguggcacaaucucggcuuacuguaaccuccaccuccuggguucaagugauucuccugccucagccucucaaguagcugggauuacaggcaccugccaccacacccggcuaauuuuuguguuuuuaguagagauggaguuucgccauguuggccaggcuggucucgaacuccugacuucaggugaucuggcugccucggccucccaaagagcugugaugguauaagcgugaggcacugcgcucagccagguuuuucuuucauaacaacaaauucucuacuuuuuagggaaaacuucuugggaaauagucucuagagcugagaacucagaaaguuucuaaaagaagaugugaucugaacaagaggaaugguagaauuuggaaaagacugagaaagggcauucuaggugggaauggauccaugaagaaagcucaacgacuggaaugagaagggcaagugaagaacugagaaagaaugaugaaguacaacacauuucccugccuuucucagacaaaaaaauguaucagcaacuagcaaaaacuacaaagaaagguuucaaaccccaaauauuaacgcugaaagucaaaacaaaguauugucuugcucuuuuaaggcugcaaaugccucucugaaagccuucugugaucacuguauaaaggaauggguaauaaacucacauaaagucaagacuggaggguauacuaaacauuuugguuuugcuuaacccacaguggaucaaucaaaauuuuauccaacuauuaaccuacuaauguuuucaacagcuacaaccucuuagaacauguuuccuaaauguaccacccaaauugauuuuuaaaaaauuaauccuuuuacguaucuacucugagcaucuaaaugauuucaaaaaaaauuuucuuuuuuuuuuuuuuuuuuuuuuuaaagacagaguccuauucuguugcccaggcuggagugcaguggugcuaucuuggcucacugcaaccucugccucccggcuucaagcaauucugccucagccucuugaguagcugggauuacaagcaugcaucaccgugcccagccaaaaaagaaaauuuuuaaaggaccauuuaaucaaucuauaaaaacuaccuuugaaaaagacaacuucacuacuuauaccugucuuauguaauacaccuaccuuuuuggauucuugcugugugaucgggaccuaaaaaaaaaaaauauguauuuuuagaaaaguggcuauaaauaagaaaacagugcaguguuacauuauauucuuccugauuucuaauguuuacauuaauuuuauaaauacaaggcguguaccuacgcacacaaaauuuuccaaaagacaccacaaacucgacagauuucuucaccuugcaggguuugcuuaacucaagaauaccuggcucuuaaagaauauguuccuaggagauuaaaacacaguacagguugaguacuccuucuccgaaacgcuaaggaucauaaguguuucggauuuuuucuguuuuuuguuuuuguuuuuuuuuuuuuuaauuuuuacauuuuuuguugccuaggguggucuugaacuccuggaugcaaaugauccaaccaccuuggccuuccgaagugcugggauuacagguggccgauuuuuuucaaaauuugaagugucugcauuauaauuuacugguucagcaucccuaaauccagaaaccaaaaucugaaaugcccuaauaagcaucuccuuuaaaugcugccagcacucaagaaguuucagauuuugaagcucacuggauuucauuuuuuggauuugggaugcucaaccuacauaucacaacuugcuaauuuuccagaaaccacuuaccagcuuggaaaaaauucuuuuauaucugucauuucuuuuuucccuucugggaaaagagugaaauuucuauggucugagaucuacauacucuuggagcuacaaccucauacuauaaucucuagaacaccuaguucaaucuuacaauguguuucuucaaaugaaaugagauacucuacuuaaggcacuugucacauuuccuagcacacagguaacgcucaaugaaauguaaagugaauauuauggcuaguaggacaccacagggauuauuauuuuuuuuuggaugauauauagcauuguugaaagcaugacuuugagaucagccagauuugaguuuuauuucugguucuaccauucacugucugugugaccuaaguaaguuacauauccucucucagcuuacucugucacuagcaaaagagggauacuaauauaaauuuuacugggguggagugggggugggguuuauaaagauuagaugaauauggauaaauuccuuacuacagugucuggcauacaauaagcacccaguaaaugauuaugauuuuuuucuuuuaucccaucuuauauaauuuuauacuaguuucuaauuuccucaucuuccauacuuccauauuucuuuaagcucacagauucaacgacuuuuuuuuaauguuucugaaauuugcauuauauaaucacugucaaaagaaacuugccauuuggcaaacaaaggaguaagaugugauauacuuuuucaucaucuacaaaugugaaaauguaguccugcaaagaaauucuguuccauguuacugucaccucaauugaaucuuaaaaugagauucccaauauuacugaaaauuccacuuauauauuagaauacugggcaauauucccauaaggacuuacuauacacaaaagaacaaguagauaaaagcucugagguaaacuuuacaguaaaugaagaaaucucucucucucaauagaggacugacaucacuucuccuaaaaagggaccauauagacauguaguuuuguuucacugucuuuauggugcaaaaagauuaccugguuauaagccaugugacacaaacgaagucuguuuaaacuucuugaaauauacugaguauauaauaugcucaaagaucgaaggaagugagcauaaccuaauacuacaaaggguuuuaauuagcuuaagcacaucugcuaacucuaaagagaagguauuuaaauuuaagacauuuaaauguaguaugauucaaggaacacuauaaauuaggacuacaggcaaaucauuugugauauaacuguccauccuaaagcugcugaaguuaaaaagaugaguuacaaaaaaauguugccaccaugaugcuaugugauuuuagcugccaaugguaaaagugacucagaagaauguuuagacauuccaaauacuagaauucuaagauuuuaucaauuaaugaauaccaauguaagaggaauuauauacauuuagauauuuuuagacuuuuuaauaguuuauggcuccuagaauugaggaacuaaccaaaguucaauguaaaaaaaacccuucaaugaaacaaccacccuuaaaccuuuuguuaacaaaauacaucauaaaaaaaaaauaauaauucuaugcuaaccuggugcaaaucuagcccaauaugaaaaaucaaagggcuagaaaaggauuuuguuauaaaucuuuuuuuuuuuuugagacagagucucgcugucgcccaggcuggagugcaguggcccgaucucagcucacugcaggcucugcccccccagguucacgccauucuccugccucagccucccgcgcagcugggacuacaggcgcccgccaccucgcccagcuaauuuuuuguauuuuuaguagagucgggguuucaccguguuagccaggauggucucgaucuccugaccucgugauccacccgccucggccucccaaagugcuggaauuacaggcgugagccaccaugcccggcuggauuuuguuauaaaucuuacaagauacgaagcauucuuuauucacucuuccacacauuuuaaaggaaaucacauuccguuaaauggccaagaguuacgauacuuguauaauuaaacauuuauauaauucgcacaguaauauuuuuuaaaguaagcagaaguuucccacgucccauaacagauuuaucaccaucuaaaauuuaaaaucaauuauaucucuuuuuagaaccacagagauucaacuucaauuacuuggcccauuacuccauaccuccucagcuucucccuuucuucucucucucucucuucucuucguuucagccguuccugguuucuuuucuccugcuucucagcuacgacucucuuaaaaacaguaauaaaugaggagaauauuuacugaguccauucuuaaacagcuuuauccuaaacuuuauauuaucugguuucuaauacaguacaacugcugucaaaaucuguuuaauaauucaauuugaaguacugccagaaauaaucauuaggccuacaagucuucuuuccauaaucuuuccccauuuuguggaaaauguguaaaauuucaccuuucuccaugauuucuacuugguuuuuuuuuuuguuuuuuuuuuuaagugaaaacaaauuauuuuaaaauagagacagaaucucgcuauguugcccagaugggucuacaacuccugggcuccagugauccucccaccucagccucccaaaguguuggaauuaacaggugcgagccacugagacuggccuaugaucuuauuauuuuuuuuuuagagacagucuuacucuguugcccagacuggagugcaguagcaccaucucggcucacugcaaccuccaccugccagccucagccaccugaggagcugggauuacaggcgugcaucaccacacccagcuaauuuuucuauuaauauuuuuuaguggagaugggguuucaccauguugcccaggcuggucuccaacuccuggccucaagugaucuggccaccuuggcaucccaaagugcugggauuacaggcauaagccaccauacccagcuccaugacuuuuuuuuuuuuuuuuugagacagagucucgcucugucgcccagguuggagugcaguggcacaaucucagcucacugcaaccuccaccucccggguucaagugauucuccugccucagucuccagaguagcugggacuacaggcacaugccaccacacccagcuaauuuuuauauuuuuaguagagacaggauuucaccauauuggccagacuggucucgaacuccugaccuugugauccgcccgccuuggccucccaaagugcuaggauuacaggcgugagccacugcgccuagccuuucaugauuucuuaaugacauuuccaagucacuucuacaagauuuuccuccucuaaauguuuucuaguauuauuuuguauuuuuuaaaaaaacaucaaccauuauaaaucacaaguucccaugcccugugauuucuaauauggaaauauuuaggucacuuccaauuaccauccugaugcugcugcuuuuuaaagauaugaguaaaaugcuugaguucuguugcuaggucuaucugcaaagacucccaaguaggaaccacuggaguuuuaacuuggagccuaguaacuauuugcuauagugacucuuuucgaaauuuuuaaaaaauuacuugagaucacccuagcuacucagaauacugaaaagagcccacuguuaccugagaauauggagaugucccuaggcauuuucugauucuauauuauuuuaaaugcuauggaccuugaguuaauuccaguugacaauaacaguuacaaagaaaaugacuaucccauguuuccuaucugucagccagaccucaauucaugaaaaaacacuacagugccacaauucuuaaaaagcuaucagcauauuaaaagguaaauagauuauauccaccaacacucaucuuuaccacuucagaaauaucaccaugcuuuuuuguguuuauccccucuaaacaacaagaguaaaaacuguguugucuuccccacaaaagccuauauuauuuaaguaauagugauuguccuuuuaaaaaaauauaaauuuuuucauaaguccuuucugaaguggaagcaggagcauaaaauaaaacuagagauucugcaagcuugcuauuuaauaaagaauugcaaaauauuucaaauuaauauuggguucauuuucucaaacuucuuauaaauauuauauuauuacauucuuauugaccuuauugaaaagaacaauaacaaugaaguuuuaugggacucuuuuaguaacuaguuugaaagaucccuaacucggugucauaucuaauauaaaaugguaacucccaaaauaacaggauaauauuaagucuguuucucaggcagcauccauuaaaccaacuugaauuuccaucuauaauccuacacuguuuaguauuaaucauuagauacuauauuacugaaucauagucaagaauauuguacaaaaaggcaacugauacagaucaaaagaacaagaggauaaagugaggaauauuuuaccaauguaccuuuaauucuucaagcuucucucuuauuucaauaaaucccaggugcaguuuacccccaaaaugaucagccagucgucugucauuaucaugaaguccuaaauaggcagagcagacuucacagacucgaaguuucugcugcugaaaacuggaagcuggcauagaauuccgauaaacuuccuaaacaaaagugagaaaaacaaugaccauauaaaucucacuaaaagucauacaauuaaauaaaauauacuaugcuuauaccaaaaguguuuucuaaaaaauacacaaaaguggcugggcacgguggcucacuggggcgagacuccagcucaaaaaaaaaaaaaaaaaaaaaccacaaaagcauggcuauuuuguuaugaaaauuauagguucccuuuauccccauccucuauccuuagcgccucucuccacuggaguauaaggaaauaauaaacaugaacagaaaucaaugaaauagaaaacaagaaaaaaacaauaaaaucagaagacugguucuuugaaaaacaaaauaaaacugaccagcuagauuaauuaagaaaagacacgaauugcaaacauucuacagauauuaaaagagaacacuaugaacaacuuuauaucaauaaauacaacuuagagagauuuucugaaagacaaauuuaccaaaaguauuuuaaaaaacaacaacaacaaaaaaacaggccaggccggguggcucacgccuguaaucccagcacuuugggaggcugagguggacagaucaccccaggucaggaguucaagaccagccuggccaacauggugaaagccuaucucuacuaaaaauacaaaaaauuagccgggcaugguggugcacaccuguagucccagcuacucagcaggcugaggcaagagaaucgccugaacccaggaagcagagguuucagugagcugagaucgcaccacuacacuccagccuuggagagagaguaagacucugucuuaaaaaaaaaaaaaaaaaaggcccuggugcagugguucaugccuguaauccuagcacuuugggaggccgaggcagguggaucaccugagguuggguguucaagaccagccugaccaacauggagaaacccugucucuacuaaaaauauaaauauuagccaggugugguggcaugggccuguaaucccagcuacuugggaggcugaggcaggagaaucgcuugaacccgggaggcagagguugcggugagcugagaucaugccauugcacuccugccugagcaagaagagcaaaacuccaucucaaaaaaacaaaaagaagaaggcuggacuugaacuggacucaagcgauccaccuuagccugcaaaauagcugggaccaaaggcacgcaccaccacaaccagcuuuuuccgaguuuuguuuuguuuuugucuuuuaguucaacuucucuuuaacaacuguucaauaauuuccauucaaauacauguucuuagagaaguauagauacugaaguuucaucuacuacuuuuuauuuguagucuuaccaaauuaagcagaauucgucuacuacuauuaagaauuuaccucugcuucucuuuucuuugcccgugcuuucucuacuucauccauuacuuucugggauuccuccacauucccuucagcuccuaguuguuccaccuuggcuaacaauuuaccaauuucuucauuuaacucaugaacacguucugccuaaaaagaaauaaaaaagaagaucaugaauaaacaagagaaugaauuuuaaauuucaaaguauuucagaacugcugagaaaaaacuuguuaucuaaggcaguaugugguuaaagaaugcuuucugagcguaucccaaaugaacuacugagacaucaggauguucugagccugccugccuuaccucaaugaagucagggcuacuacugggcccaauauaacuuucuauccucuggcgaggugguguauuccuaguguaaaauacgauuucuuccaugaucuggcccuuuguacuuuucuaaaccaucucuugcuacucccccaccucacaacauaauuuauaguuuccccaaacuuacccuguuguuuucuaccucuguuacuuugcauauacucuucuuucugggaugggaucccuuaccucucgccugccuacugaauauucacucguuccaacaagauacaacucaagggccauuucuguaaaacauuccugaacagucaccacaucccagccccacuuaaacacaucagcaaagauggccauacucucuccuuugugucaccuuuguaucuuuuuugacaguuccuuucauaaauaucauacuacuuuaaggacagcuaucuguauuucccaucuuuguaucucuagugcucagcaaauagccuaggcucaaauaugaguuaaagaaaugaauugguggaucaaguucaggaauccaucagaucugacuuauugcuaaaccaauuacuaucuguguaauuuuggccacauuacuuauaccugaauucauuuccucaucuaagaaguaccuaucccacaaaguugugagaaaugagaaaauaagccucguauguacccugcauagcaccuugcugauuuucagcauacucgccuggcaacuccacucuaugaguccuuagcuuuccaccaggauuaacucuggccuugggaaagaauacguuccucuuccucaucaccaucaucauccuagcaacuuaguucauuccuacuguuguaauggcacauaaaacauacauauaaucauuauuugggccacaaagucuuugcuguauggccaauuauaauauguuagcaaagaagguuuuaauuuuuuguuguuauuguuguuuuugagauggagucuugcucugucgcccaggcuggagugcagugccaugauuucaguucacuacaaccucugccuccuggguucaagcaauucuccugucucagccucccacguagcugagauuacaggcgugcaccaccaugccuggcuaauuuugcaguuuuuguagaaacaggguuucaccaugguggccaggcuggucucaaacuccugaccuuaagugguccacccaccuuggccucacaaagugcugggauuacaggugugagccaccacgcccggccgaagguuuuaguuugguaugaguuuccagucccaacaaaccaguuuacugguuuaauuaauagucuuuacuucucaaauauccuucaacccaaaauauuucuucccucaaugagaguccaauucuauuaucacuauccucccucucuaccaaaugguauuuuccuuuaaauguaucauugaaugacuaaacuguuguccaaaacucuucuuucuucccuguauccauguccuugaccauguaauuguguaccaucguacucugacucugaauuuggccaugaacuugcuuugguuacugagaugguagcaaacaugaccaaaggagaggccugugugauggggcuugaugcuucugcaccucuaccaccacuaugagaacacggccaggcuagccugcugggcauggcucugcauccucuaguggacugcaaggcaugugaguaagcccagcugaaacaagaauaacugcucagucaaguucagccuaaaucacugacugcagagucaugggcuaaauaaauaguguuuuaagucacugagcuuugaggugguuuguuauacagcauuuguguagugauggauaaccaauacaaccaauacaacucaggcucuaccaagcacuuacagaucucuuccaaccaugagauacuagauccuuuguacuucaggaugcccgucuuuccaguccccaucuucagagaauuuucagaaaagguugacuaaaagcaacccuuuucucaaacgauggaaucuauuuucauuuguauauacauaucugaacaccauauuuuaauacugucaucuaaacuccaccuggguaacucuuuuucucccauucugcauuuucauaaaacacacuugaucauacugaauggaauauaauuauguuguaauaagucaucaacaaaugcaauauaaaagaccuuguuuggauucuaauaaaucgacucuauaagaaaaauaaacauacacuggauaacauuaaaaaauuacuguuaacuuuauguauguauuacugugguuauaacuuacaggugaaauauugacauuuaacauuugcuuuuaaaagcaaauaaaaauacugugguauaucuguacaauggagaaauaaaaaggaaugaacugauacacacaacuugaaugaaucucaagaaaguuauauggaaugaaaaaggccaaaucucaaaagcguacacaggauuucauuuauguaacacuccaugaaauaacauaacuacagagauagagaauagguuagugguugccaaggguagagaugcuggguggggguaaagauggauguagcuauaaaagggguaacaugagggagucuuguggcaauguuauacuuaagcauccuaacuguggcuguaauuacacaugugauuaaacugcagagagcuggccaggcgugguggcucacaccuguaaucccagcacuuugggaggccaagguggguagaucgcuugaggccagaaguuugagaccagccuggccaacauggcaaaacccugucucugcuaaaaauaaaaaaaauuagcugggccuggugacgcacaccuguaaucccaguuacucagaaggcugaggcacgagacuugagcccagaaggcagagauugcagcaagccaagauuacaccacugcauuccagccugggcaacacagcaaaacucugucucaaacaaaaagaaaaacaaaaaaacugcacagagcuauacauacagacaugcauacacaaauaaaugcaugcauaacuggcaaaaucugaauaaaauauaaggauuagaccaaugucaauuuauuugauauugcacuauauuguauaagauguuuacacuggggcagacaagaaaguauacagaauuccuuguauaugucuuugcaaucucuugcaaaucuaauuauuucaaaauaaaaacuuaaacaaaaggagucgaaauaauacuuuguacuaaugaaaugauuaaaauucuuaccuuugcugcuacuucagcacuaaucucuucuugaguuucugcuaaucuuuucuuggccacuucuguucuacgaucacaaucugcaaugaaugacugcagaugauccauggccuacaaaguuuaauuaaagacaauuacugucagaaagucaauuuuauucagaaauaucuucauacaaaaaucacacuuugcuuuuuaaaaugcuaccaugguggggcacgguggcucacgucaguaauugagcacuuuaggaggcuaaggcagacagaucacuugaggccagccuggccaacuuggcgaaacucugccucuacuuaaaauccaaauuuagccagguggguggggcacaccuguagucucagcuucucgggaggcugaggcggaaggaacacuugggcccaaagaggcugaggcugcagugagcccugaugaugccacugcacuccagucugggugacacagcgagacccugucauuaaaaaaaaaaaaaaaagaagcugggcguggugggucacgccuauaauuccagcacuuugggaggccgaagcagguagaucaccugaaguuaggaguuugagacuacgcuggccaacauggugaaaccucgucucuacuaaaaauacaaaaauuagccaggcaugguagugcgcgccuguaaucccagcuacucgggaggcugaggcaggagaaucacuugcaccugggaggcugagguugcagugagccaagaucgcaccacugcauucuagccugggugacagaaugagacugucucaaaaaaaaucacuugaggacaugaagaaauguucaggauucauuuguaaauaaaaagcaaauuacaaauguuaugcaguaagaucccaauuuuguaaaauaaagacagaaaaaucugcugcaagucuagaucugaauggacaaaaagaaaauacagaaaaaauggaaaacuauacaaaaugcuaacaguaaguauuuccgaacauuuuuacccuuuuuucuuuuaauucuccaaacugcuuuagaauuuuuuuuuuugagacaagagucucgcacaucaggaaaacuuaucuuuuuucagagaauaaaccauugagaauuuuagcaguaucuacacuauaaaaauucaauauuuauauaagacauuugugaggcacauauuaaugucuacaauuaauaguucauuuaaaaguaaacuuuaagaauucauucucaaguuuggacuuccaaaucuuacuguacagaaauauaacuaauucaagauacaaauguuugaacuaaaaauacaaauuuauucagcacacauugaauuccaaaaauaguuggauaacccaagaauuucuucaaugugaaaagcaauaaggaucauuucuuaaacagcuuuuaucugugauaacauaaaaauaguuaauuucuuuuaauuugaaaauuuuuaaaucacaacagaaaucuauucaaauuuccuuauguaaagauaaagauggcaucucaaagcagugagagaaaagauggacuaaucagcaaauaguguugggugacuaaguagcuaugugggguuggggggagacuagauccauaucucaguuccuuaaaccagaauaaaucugagaugaaucgaggacuuaaaagucuauaaaaugaagccaaaauaugccagaagaaaccacaggagagaacucuuagcaccucagaaaaagaaaagcguuuagaacuaaugaaauagauuugguuucucuguuuguguuuugagacagagucucgcucugucccccaagcuggagcacaguggcaugaucuaggcucacugcaaccugacucccggguucaagugauucuccugccucagccuccugaguagcugggauuacaggcacccaccaccaugcccggcuaauuuuuguauuuuuaguagagaugggguuucaccauguuggccaggcuggucuugaacuacugaccuuaggugauccaccccugccucggccucccaaagugcugggauuacagccucccaaagugcugggauuacagugcugggauuacgagccaccacgccuggcuauagauuuguuaaagacugauaaaucagaagauauaaauauaaaaauacccccgcaaggccaaaaaccaccaaaaaaguagggaaaauguguuguaaauuauauuucugaaaacaauuucauuuccauuagcagaaauucuuggauauucagaagacaagaggaccuguuuguugguuuaucuccuaaaaccaaauuuaaaacaucuauuauuucacuuauaaaauguaucaaagauuuaugcacauuaguauguuuuauguaaugcugauuauauauaugcaaaaaaacuuuauuuuuaugcaaacgauuuucauauaaaaacagcaauauaaaguuacauuucaggcuuuuuuagguaucuaaauggugucuuccauuucuugguuuuucauuaaaaacacuguccuuaauaucccccaaacggccgggugccguggcucacgccuguaaucccaacacuuugggaggcugaggcgggcggaucacgcggucaggagaucaagaccauccuagcuaacacggugaaacccugucucuacuaaaaacacaaaaaauuagcugggugugguggcaggcgccuguagucccggcuacucgguaggcugagacagcagaacagcaugaacccgggaggcagagguugcagugagccgagauugggccacugcacuccagucugggcuacagagcgagacucugucucaaaaaaaaaaaaaaaaaaaaaaaaaaaaaaaaaaaaaaucccccaaacacccauaugcaugucccucaguaucugugggagauugguuccaggagacccagcggauaccaaaauccaugaaugcacguuuaauauaaaaugguguaauacuugcauauaaucucccaguacacauccucccauauacuuuaaaaugucuccagauuacuuauaauaccuaauacaauguaaaugcuauguaaacaguuauacuguaauguuuggggaauaauaacaagaacaaaaugucuguacauguucaguacggaugcaacaauccauuucuucugcuaaauauuuacaaucccaguugguuccuucuacagauucaacgacagauauggggggccaacuauauauacauguauauauauauauaaguagauucaaaaauaaauaugaauguaaaaacucaguauauuacuaaagauagguccuuauauacacuauaaauuaguugcuuacauuugcuugauauuuccuuaaucauuacuauuuuguugggaagaauaugcuuaauuuccaaaagaauauaugaaucauacgacuguuacacauuuucuuaaaauacagucucaccucauauuuuuaaaagaguugucaagaaaguacaugaucuuacuugagucuuacccuucauauaaccagaggauaaacugcuaagaguuuuuccuauuaagagaucuuaauccacauucacaauguuuuacagcaaaagauaacaacaaaccauuaaagcaaaaucacauacaucaaguucaaagaaaaaaucuuguucuuuggaugcaauuucauaauccgcucuuaaagccaggucauggacuuucagacauucuccaagauccauucucuggaagggaaaaaagacauaauauuaaaacaaaaaaaaguuuuuuaaaaaaugcuucaacaaccacaguucuugucagaauacauauuaagucauacagaugcuuuuuuauguaggggcuuccaaauuacaaaauuucauagacaaauauaaaacguggugucagaagaaaaaaauggcaccaauuuugucuaccaacagaugggaacagggaucacuuguauuuaagaauaaauggauauggaaaagcuuuucagaaucugaaaaaagcuagcuucuauaucacaacauaguucauuuagcuccacaacacaaaaaagaucaaguuaauuuuaaaccaaacuaaaagaauauauacaucaaauuguugagaugucaaugugcuuugaagaacauccuauuuuucaaauaaagauggaguccucaaaaaccagacugguggccaggcaugguggcucaugccuguaaucccagcacuuuggaaggccaaggcaggaggaucgcuugagcccaggaauuugagaccagccuagccugggcaacacacuaacaccugucucaauuuuaaaaaauaaaaaauuuuuaaaaacccacaacaaaacaagacuguugacuuugauauagucuugucuggggacaagacuccauauaaacuaguaaagaggugauuuacuaguaagacccaacauaagugcacagagaacaagcauuuaaucccacuuauaauaagcauguaucagggaaauaaauacucuuacugaaucuaggguccuucuacuuggaaauuccaauuagguguuauuuaccaaaccagaggcuuuccucauaucugagacaaaauaucuaaaaaucuauccauuuuuauauguaucuaggcaacuguuaagaucuuucaugaaacuuuuuugggggaaaauaugagaaaaaauuggcaagaugcaaggaucauuacagguaugauuaaucggugaugaaagcaaggcggagauuuuccaacuggaggugugaccacccuuggaauaccucaaaaucucuggaggguugguaaaaagggaguacaagucauucuccuuccuuugacuauuaaguucccacuugugguaagcacuacuuuaggugcuagggauauagacuuaagugacacagacagucugacuucauggagcuuacauucuauuugaggggaaacaaauaacaagaaucaugucuaugaacaaagucagaugauguaauaaaauagcaauguuccccauuauuaugggggccuacuugggaugaguuggucagagaagaccuuucugaagaggauacaauuaaacuggaucuaaagagggagaagcaaaugaaucuuaggaaaaggcaaaaaguaauguuccagguuguacagaagauuuagaaggcagaucuuuaaaauauuuauuuauuuauaugccacuauuaaucacagggaaguuuaugguaacagggaacaggaauagaguauggcacacaggucugagccuuagcuuuguauacaguaucuaaaaaugaguaugccuauuuaacuugucaacaaccuaaauauguauaaaacaaacguaugauaauuaauuuuauaaaauaucccaacuaaaaaggauagcuaaugcacgagaucaagauucaaaaguauuaauagaccagauaaaauuuaaaagaaauaaauaugaaguccuauaguuacauauccaagacaauaaauuuacaaauaaguagguaugagcagagaaucagacauuuuaaaaauguaaguagucaagaguaacaguuacagcauggcacaacugagaaaaaucuauauugucuaaaacuaacucaaagaggacacaguauaaacaaaguaggaacucucuacugaaggcugguuuuaaaagcaaaccacugcucuccaaaacacacauucuauguacuaacacauuucaaaaggaauaugagaaaauuagacaaaguaucucaaaaccaggcugcacaaaaaagccagggaacagaaauaaauagagaagacaaaagaugugaaccaacuucaaucaacugaggaauuuuucauaaagcagcagaaauagauuuguuuuauuauggcccgaagggacuccaaugagucagacuucaacucucugaauacuuuuucuucuuuuuuugagacaaggucucacuuugucaccuaggcuggaguguaguggcauaaucauggcucacugcagccuccaccucccagcucaagcgauccucccaccuaagcaccccuccccgacaaguagcugggaccaccgucccccgccaccauauccagcuaauuuuuuuuuuuaaguagagacaaagggugcuaucuugcccaggcuggucucaaacuccugagcuugagugauccucccacuucagccucccaaugcuggauuacagguaugagcaacugcaccuggccaagaaaauauuuucaauaaucaaagcuuucugaagguagaacaaacauccucagaguuagggaguucccagauaaaugagauguucaaacacuguuuugacaaccauuuuauuaggauauuaaggaaauaauucaaccaucagguagcuuuuuucuuccuucggacucuuagauguugugacuauuaaaaaaaguaaaaaacacacaauguuucuggccacaguggcuaaugccuauaaucccagcacuucggggggccaaggugggaggaucacuuaagcccaggaguuccagaccggccuggguaacauaagaaaaccccgucucuacaaaaaguaaaaaagaaaaaaauuauccaggcaugguggcccaugcuuguggucccagcuccugaggagacagaggcagggggaucacuugagcucuggaggucaaagcugcaguaagcugugaucaugccacugcauuccagccugggugacagagcuagacccugucucaaaaguaaaaacaaacagaaaauguuuuucuguaaaacuauauuaccuucaguucuuaauuauauaauggaaugaaugggaacguauaaauucugcccccaguuauccuuugggaaauaaugaggacucaucacuguuauaaaaguccucaucaugcuuaaugguauuaaaguacuguacuguuacugagcaugcugagauuuuuccaggcuccaauccuuaccccccgauucauuagucugguuuaacaagcuaaggaguuuuucagugacaauaaacaaaaaguaaagcuuucuaugauguguagaaauucaaauuuaaaaggugcucauuaaacaauuauuaagaaaaugcagaaaaacuuaaauauuccuaagaaagaauuccagaaaauauaacaggaaugaaagaagcuaauggcagaaggaugcugucauugucuuugauaugccaggcaguacguuucugaaauuaacaauuucuaaacaucaaucacgccaacaacuuccuuaauauuuuauuuccacaagcuauagcuguucacaugaugcuacauucuauuuuauuucauaaaaugcaagaugucacaguuggaaagacuuuuugauccacugugguucucaacuuagaccuggggaacuuuuacauaauauugauggaagcuuuuaaaaaacagucccaauuccuaccucccaaagacugacugaauuguaaaagccccccagguauuuuuaaugugcaauguugagaaccacucacugaucuaguuuuagucccauucuuugcacagaaagaaugacuugcucagggugcuuaucagaaaaucugguuagacugauuccuagucuaauauugcuuccacuuuaccaugcuaguuccgguuauuucaguacuaacuuaccuuucaauauuuuucaguaagucauuccccacaacaucuaagaaagcucaccacagagauucaaagcagcugucuacuuccuuucuuccguaucuccuuuaucuuacuuucaucaguucccugaucaacuacauuuccaauccguauucaacaaaaacuuaaaaguaacacauaaauuuugccucauuguuuuuaaccuaaacaucucugucucuauugcaauaauucuaggcucccugccuccacuucuuuaaaguuacaucacacaaccaaccaaaggaagaaaagcaacuauguagacuaagaacaaaaugaacacaagaaagauacaauuuuaccacuauaguagagguggacuuuuuggugagaguagccuuuuggggaaggcaugccauggggaagaugcaugagagggguaagauuaacucacuaaaaugugagcuccauagggcaaggauucuucuguuuuaucuacgaugugccuauguugaauaaaucaaacuaggaaagagggcaaagaagaacauuuggcacagggcggcuuauuaacaagccagaguggucaagaugaauuccaggacaaaacugaucugagcuucuggagggagguucuucuuagccucuccuuggauuaucucuuuugcuuggacuccuuaccuucuuaaguguuuugagcuauucuucuuuuuuccuccaagaggcaggcuaguugggcuugucacuuucugggcucuaaguccuugcaaguuuauagccuagccugacucaucauaguagauuuuggugucaaagcccuaggaccaagggccuaauuauaauaaagaaggcuuuuuuguauguggaauauccucagugguuaucucuucagggaccuagugggacaguagguauagccaaggcagauuuucagaauacuagucaucuauauuccucuguccauaccaugaugacuacuaagcaucuacucuggcacugugcuaugcacaugagaaguacuuaaaauuuaaaacauggucaggugugguggcucacuccugaaaucccagcaccuugggaggccaaggcaggcagauacuugaggucagaaguuugagaccagccugggcaacacggugaaaccccaucucuacuaaaaacacaaaaaauagcuggacaggguggcaggcaccuguaaucccagcuacucaggaggaugagguacaauaaucacuugaacccaggaggcagagguuugcagugagcugagaucgugcacuccagcccgggaaacagaguaagacucugucacaaaauauaugauuauuuauuuauuuauuuuuacuuuuuuagagacagggccucacucugucccccagucuggaguacaauggcaugaucucagcucacugcaacccuaccucccagggucaagcaauccucccgcuuaagccaccugacaccugaguagcugggaccaacaggcacacaucaccauacccggcuaauuuuuuggagacagagucucgcucuguugcccaggcuggagugcaguggugcaaucucagcucacugcaaccucugccucccagguucaagcaauucuccugccucggccucccuacuagcugggauuacaagugugcaccaccacaccuggcuaauuuuuguauuuuuaguagaguugggguuucaucauguuggccuggcuggucuaaaacucuucaccucagguaauucaaccgccucggccucccaaagugcugggauuacaggcgugagccaccacaccuggucuuaaaauuuuuuuuuuaauuuaacaaguaguugcugggugcaguugcucacgccuauaauuccagcacuuugugaggccgaggcgggcagaucaccugagguugggaguuugagaacagccugaccaacauggagaaaccucgucucuacuaaaaaaauacaaaauuagccgggcgugguggugcaugccuguaaucccaacuacucgggaggcugaggcagaauagcuugaaccuggggggcagagguugcggugagccaagaucacaccauugcacuccagccugggcaacaagagcgaaacuccaucucaaaaaaagacaaguaguuuacuucauaauuaaauuccuuccacaagcuuauucuugguuuuuaauauuuuuacaucuaaaugcuuagauuguagauuuuuuaaaaaaugcuuauuuguaauuaaguucaguucugcauuuugucuucuccauucugaauccauuacugcaugaaauguggaccaaauaacuauaccugauccugguaacuuauagcuccacagcauuuuauauuguuuuacuaacaaagguaacaaaguuaaaucgucaagaauuuuuaacuuuucuuuugaaauuccaaaagugaauguuauuuccccaaauaaacucuuaagcuucauuagaaaaaugguccauuuuucuuacuuaucccucccagaagaccagguuuugcacaaaccaugacuacugaauaaaccugauaauuugacuaaggaauucuauuucuaaggaauuaagagugaaauaauuauaaaaagauaaauggagaauaaaguuuaacaauguuguuuuuuauacaagaagaaacauuuuaagagccucucaacagagguuugguugauucagcuauggaauagccauacagugucuauuuagccuuuaaaaaugauguucuugauauaccaaguggagaaaagagaagguggcaaagaaagacauaauaaaauacgaauuuuggaauuuacaaaucuauauuacuaugaggguuguuugaacuuucuaguacugguugaauuauaagcaaugagcaugauuauuacuacaauuggaaaaaucaaugaagccaggccgggcgugguggcucacaccuguagucccagcacuaugggagccugaggcaagcagaucacuagaggccaggaguucgagaccagccuggcaaacauggugaaaccccgucucuaccaaaaauauaaaaauuagcugggcauggugacaugccuggaaucccaacuacucaggaggcugaggcagaagaaucacuugaaccugggaggcagagguugcagugagccaagaucaugucacugcccucuagccugggugacagacugagacccugucccccccaccaaaaaaaaagaagccaauuuaauuuuagagaaaaaaaauugagaggcaugugaaaacuauacauuaaaaucaacgaauagacauauuacaguagagcaaaucaaaagguugauuuauacauuuugaguguacugcuaaguguaaauuaauaguaguaauauguuaaugaauauauaaacgauagaauuuggcauaguaauagcuccaaguaauuguaaauauaacugcuuuguuauguguuugaacauuuguucaguucuaagaaccagauccugaacaaaauuacagaacagcaugagaauauaauuucuacuauuauggaauuuauauucacaauggaaaucaaggccuuaaacuaaagcaacagcugcaagugucuacaaagauguacauacaaggauuugacugccacaguguacaccaaaaacagaaacaaagacuaugaauauauuaauacucacugcauguaagagaacagccacacuacacaauauuauucaggcauuuuuaaaaaugcagacaacugauauggaaaccucuccaagacaagugaaaaaaauucaaacaauauaauggcaucuguuaaaacacacaagcuugugugcacaagcauuuacacaaggagagugaaagauguacacuaaauuguugacaagguuuagaucugagaaggagggugauguauaauuggaaauauucauguuuuaugcuuuauucuccuguacuuaaaaacuacauugucuaggcccggcaugguggcucacaccuguaaucccagcaguuugggaggccgagacgggcgaaucacgaggucaggagaucgagaccauccuggcuaacacggugaaaucccgucucuacuaaaaauacagaaaaauuagccgggcaugguggugggcgccuauagucccagcuacuugggaggcugaggcaggagaauggcgugaaccugggagguggagcuugcagugagccgagaucgugccacugcacuccagccugggcgacaaagcgagacuccgucucaaaaaaaaaaaaaaaacuacauugucuaaguaauaagacagacuaggccagacgcaguggcucaugucuguaaccccagcacuuugggaggccgaggcagguggaucacuugaggucagaaguuugagaccagccuggccaauauggcgaaaccccaucucuacuaaaaauacaaaaauuagcuacucaagaggcugaggcaggaaaaucacuugaacccaggaggcagagguuguggugaguggagauggcgccacugcacuccagccugggggacagauugagacccuggucuccaaaaaaaauaaaaauaaaaaaaaaaauaagaaaaaaagagagagagagagagagagagagacugggcacuggaccacaucaaaacaccucucuuuaccucguauuauccauuugauccugagaaauucacuuaaacucucugaccuuccaaccuggagugcaguggcacaaucauagcucacugcggccuugaauuccuaggcuuaagugaucuucccacuuuagucuccucacuagcuagaaguacaugugcaugccacaccaaguuaauuuuuuuuugagaugggaucuugcuauguuguccaggcugguaacuccuggccucaagugauccugccugcgccagcugaacuucuguuuucucaaguacuucaggauugcuguucagaucaaguaagauguuuauaaaagcacucugaaggcaggcugucaaccuacuuauuuuugcauauugauugcaaugggauauaagcucaaugagggaggaacauagucuuucuugaucauuguaacagccccaaucagauaacacaguccaccacauaauagguacucaauauuuuguuacauaauaugauauaauauuauauuacagcucaauauuuguucaaugaauaacuuauuuccuuggcucauaacuuuaccuacuucuaaugcuuccauuuucaagcaaauucacaaaagagggcuaucuuuauuaaauaucaguguguaugaggagguuucuaggacaagugaagauaauuuacacagaagacaaauaauagagggaaagagccagagcacaugcuucaagaggagaauacaguauuuccuaucgggaaaauaaagaggaacaacuuaacuggaacgagaagauuucuacuagaagauaaaggaaaaugauggggggaaaaggggauguaggauuauacuggcccacaggccacuaguuuacagccucugacuagauggugaaagagucugaaaaugagucaaaaaaaaugcagaauuuauucuguaggcaaagaagaaugcuugacuacucaggcagaaauacgacacaauaaaauccauguuucagaaccauuaacacuagauggauugaccagaagaaagagacaaagggcaagaaaagauauuacaagaaccuaggaauaaagccacuggggucaaauuagaagagaaaaaagaaaggaggugacagagguaaaccagagugccgaagaauuaaaaaaaaaaaaaaucauuuaaaaaaugugaagugucucuggaauaaugaaucccaucacaccuucuuacaaauauggaaaucaagacucagacagaucaauauuugccuaagaucauaagcuaauggcagcagaguaaaaaucucaacaggucuuuaauauagcucaauauucuuucaauaacacaauaacuuucaaccuacagguauuagcuaaauggaaauuaaguguggaaagaaaaaagucaggagucucuucaggguuucaaguauuucaaacaugagaaaacaaugaugccaccaagagaacugacuaaaucaaaugggaaaacugaucuaugagggaaaaugucuuguucuggacaagaugauuuugauguaauaacaggaaaucuaaguagcagcaucuaguaugauacagauauaugacuacauucacuacaggcuuucuuuauccaaguuuuccaggaugaaaguuauacauauuccuccccauaguuacagcucaagcauuuuuccagaagaugcucuaacgaauuacacaagaacacggagucugacccccauguuaacaaguauaccuuagacaugaguauagggugaagagaaauggggcacauugugcauacauaacgcugcugcuuuucuaccacuucccaauuucuuaacugccucuucccacuuguauauguuccagcuccaaaccuauuuuucccaaaguaaagauaaaucaugauauuuuucuaccuuuuuguaauuuucuuaagaacauaggaaauauuuuuauaaccauuucugacccuagauaugcaaagaaaacuagaaaaaguuaaaacaagaggucuuaucacacaaagacuaugguguacuaucuaacuggaaagagagagagaaugagaauauauacacaaaugagauaaauuuuuuuucaauaguacagaaagcaggugcuauacugggguucagaggcuaaauuguuacaggguaaggcaaucacauauaguaagccagauaggauuuaaauuuguagagaggagaaagaauauugcaggcagaagaaaagaguguaaacaaaaaugagaagcaugcgagggaaagaaaggagugagacgacaauaaguaaaucaguuuggucaaacaagagaaccaggccagacaugguggcucacgccugcaaucccaacacuuugugaggccauagcaggaggaucacuugaggccaggaguuucaggcuucagugagcuauaaugacacuacugcacuucaguccugcaugacacagcaagauucugucuccaaaaaaaaggaaaagaaaaaacaacuuauacgauuuauucauucaagggagaaguagccuggguaaguauuuuagauuuuucaguacagguauaaacaauacagaaccaccacaaguuuugcguaggaacaaaauggcaaguugauucccacucagaaaugacuaccuucuucuccacauucgaucucaaaugucacuucaucgaaaauuuucuccauuuguuucuuuuguuuccaucaggaaacaagagcucucguauaaaaaauaaauaaauaaaauaaaaauuuucagccaggcgcaguggcucacaccuguaaucccagcacuuuggaaggccaaggugagcaggaguucaagaccagccuggccaacaugguaaaaucgugucucuacugaauauacgaaaaaauagccaggcgugguggcaggcgccugcagucccagcuacucgggaggcugaggcaggagaauggcgugaaccugggaggcggagcuugcagugagccgagaucgcgccacugcacuccagcuuuacaagucauauuaucugaguaaaaucaacacauaucuuuauuuuugauccugcaagccaaaaaaguuuaugagaccauguauucucaaaaugcucuggccgggcacgguggcucaugccuguaaucccagcacuuugggaggcugaggcagguagaucaccugaggccaggaguucaaaaccagccuggccaacauggugaaacccugucucuacuacaaauacaaaaaauuagccgggcaugguggcacgugccuguaauccagcuacuugaaaggaugaggcaggagaaucgcuugaacccagaaggaggaggcugcagugagcuaaaaucaagccauugcacuccagccuggggaacaagagcaaaacucugucucaaaaaaaagcucuaauccuuuaauccuauauagguuaaaguaaaacacuaaugagcuuuuagaaguucccuuaaugaguaagaaucagcuagaaagcauuuaggucuugccuaaagguugaacucaucacauguuaaaaaauauuuccaguggccgggcgugguggcucaugccuguaaucccagcacuuugggaggccgaggugggcagaucaugaggucaggagaucgagaccauccuggcuaacacgguaaccccgucucuacuaaaaauacgaaaaaaaaauuagccaggugugguggcaggcgccuguagucccagcuacuagggaggcugagccaggagaauggugugaacccgggaggcggagcuugcaguaagccaagaucacaccacugcacuccagccuggacgacagagugagacuccaucucaaaaaaaaaaaaaaaaaauuuccagugacagagaaaaauauuuccagugacagagauuuuguaauucuuuguaaaugugcuugauguuugugguuaaucgccuguauaaagaauauuuuuaggcugggcacaguggcucaggccuguaaucccagcacuuugagaggucaaggcagguggauuacgugaggccaggaguuaagaccagcuuagccaacauggugaaaccccaucucuacuaaaaauacaaaaauuagccaggcgugguggugggugccuguaaucccagcuacuuggaaggcugaggcaugagaaucacuggaacuugggagguggaggcugcagugagccaagauugugccauugcacuccagccugggagacacaucaagacucuggucucaaaaaaaaaaauuauuguuuucaaguuuucauuucuuacuauuguguucaaugaauuacauccuccaaaugauguauuuauaacuccauauucccuuuuucaacaaauaguugcggagaacacacuuguuuccuuagaaguguuaaaauacaguugauaaaacuacuuaucucuaaaaaacaucuggaggguccaggaaauacuaagagaauaauuccugauccuuagggaaaaagcauuuauugagacucauuguacaaagaaaucaauaugacacugaaauauauuaaccaguacuagacuaugaaaaacaaucugcuucaaugacuuccagaccuccuacuuuguuugggaauaacugguuuuuacuacuuucuuuaauuucaagagucaucuuacagcuggguacaguuguucaccuccauaucccagcauguuugagaggcccaggugugaggaucccuugaggccaggaguuugagaagagccuggacagcauggcgagagucucucucuacagaaauuuuaaaauuagcugggaaugguggcaugagccugcaguccuugcuacuugggaggcugaggcaggaggaucacuugaacccuggaguucaagacugcacuggcuacgauuauaccacugcaguccagccugggugccagaaugagaaccuguuucuuuaaaaaaaaaaaaaaaaaaaaaaaaaaguaauccuaacugauagauucaagacuuuugaagauguccuucaaaaaaaagcugcagggggaauauaugugauuauaaauaaaauacaguaggcuguguguaaaauauuuccugaagcuagcugauggguacaugaaaauucauuaaauaaacaucaacacuacaguccgccauacccauaugaacguauaucuguacuuauuaauacaaguaauacacaaaagugcugacaacccucaacuagaaacaaacacuaaaccagaauaagauauuacuauacaugguuuaugggucaccauggggaaaaaaauuaccuaccuccauaagccugaauuguguuauuuuaaauaguauauaaaaugaaugaucuaagauuauucaaaauagagccagauaugguggugugcaucugcaguagucccagcuacuuaggaggcugaguuggaaggaucaacugagcccaggaguucaaggcuguauugcaccaugauugcuccuacaaauagccacugcacuccagccuggacaacacagugagacccccaacucuuaaaaaaaauuauuauucagaaugacagaaaaggauuauuuccaaagggcgugaguaccccguuuacuauuuuugaguauucuuguuccuauuugccaaaaauguuuuaaacgauuaaagccuugguuuuuaagguuuaauaguaaaauuuuaauuauucacuggcaaucuuuuaaagcacuguuaacuuccugggcaccaaaugcauuuuuuauuuaggcagucucuagaaauaguugagaauauauauuuuuguaauagacugagagaaauaaaauacagcaaaucugcuuaaaauaagaacacacuucaaaccuaaauuuggaaauuagcggggcaugguggugcaagccuguaaugccagcuacucgggaggcugaggcaggagaaucgguugaacccgagaggcagagguugcagugagccacgaucacgccacugcacuccagccuggaguauauaugaaauauauauacauuugacuaaauaucaagccaauaaucaggguuaaugccaaaaacaucagaucuccacauccagaucucuucaaauuuuaaucuuaguuaaauaauacuuaaacccuuaaauaauaccaaggcagcccaaaauaaaccauuuaugggaaaagaguuaaacaauuuacagacugauuuuucauacuugcacagguaaccacuggugucauauuuugauaagaaauccaggccagggccaggcaagguggcucacaccuguaaucccagcacuuugggaggcgccaaggugggugggucacuucaggucaggaguucgaaaccagccuggccaacgugguaaaauccugucucuacuaaaaauacaaauaauaauaauaauaauaauuagccaggcaugguagcgggcaccuguagucccagcuacucgggaggcugaggcaggagaaucaccugaacccaggaggcggagguugcagugagccgagaucacaccacugcacuccagccuaggcgaaagagcaauacuccgucacaaaaaaaaagaaaaaagaaaaaaaaaaagacaucaaggccgggcgcgguggcuuucaucuguaaucccagcacuuuggaaggccgaggugggcggaucaccugaggugaggaguucaagaccagccuggcuaacauggugaaaccccguuucuacuaaaaauacaaacaauuagccaggcaugguggcgugcagcaccucuaaucccagcuacucgggaggcugaggcaggagaauugcuugagcccgggaggcagagguugaagugagccgagaucgcgccauuacacuccagcuugggcaacaagagcaaaacuccaucucaaaaaauaaauaaauaaauaaauccaauaaagccaagauacucuccacuuugggaggccgagaugggcggaucaccugaggucaggaguucaagaccagccugaccaacuggagaaaccccgucucuacuaaaaauacaaaaaaaauuagccaggugugguggcgcaugccuguaaucccagcuacuugggaggcugaggugggagaauugcuugaaccugggaggcagagguugcggugagccaagaucgugccacugcacuccauccugggcaacaagagcaaaacuccgucucaaaaaaauaaauaaauaaaauaaaaauacaaauacaaaaauuagccaggcaugguggcaugcgccuguaaucccaccuacuuggaagggugaggcaggagaauugcuuaugccuaggaagcagagguugcagugagcugaggugacaccagugcacuccagccugggcaacaaagggagacuccuccaaaaaaaaaaagauacuucagcaguuuuuaaaguuuggguuuguauguacccacauaacugauuuuuagaucaggcuuuaaaacagagucagggaagcaauaagaaaaaggaguuucaaaucauaaaaggugcaccugggauaaaacccggaaccuacuggggcaacauaaaauucagucagaauaucugacaaccaauaaucccaucuaaucacuucaaauaagcaaauacauuuuuacuuuaauuacuuuagguugggcauggugccaaauuccuguaaucccagcacuuugagaggccuaggcugguggaucccuagagcccaggagugugagaccagccagccaggacaacaugguggaagugaaacuucgucucuacaaaaaaaacacaaaaauaagccggcuguggcugcgcguggcuguuguucuagcuacuugggagacuagcaggaaaaucacucgaacucaggagggagagguugcagugagcuaagauagcaccacugcacuccagccugggugacagggagagacugucucaaaaaauaaauaaauaaauaaagacugugacaauaucaaaguccccaauaauauugacuacgacaauaucaaagucccuaacccuaucuguaaguauuuuuuaagauugguucuuuuugggaggcuuaggcaggcagaucacuugaggucaagaguuugagaccugccugggcaacaugguaaaacccaaucucuauuaaaaauacaaaaacuagcugggggcaguggcucacaccuguaaucccagcacuuugggaggccaagguaggcgggucacaaggucaggagauugagaccacccuggccaacauggugaaacuccaucucuacuaaaauacaaaaauacaaaaaauuagccaggccugguggcgcaccuuguagucccagcugcucgggaggcugaggcaagggaaucgcuugaaccugggaggcugagguugcagugagccgagaccgugccacugcacuccagccuggugucagagcaagaaucugacucaaaaaaaaaaaaaaaaaaaaaaaaauuaggccaggcgcaguggcucaugccuguaaucccagcacucucagagggugaggcgggcagaucaccugaggucagcaguucgagaccagccugaccaacaaggcaaaaccccgucucuacuaaaaauacaaaauuaggcaggcaugguggcgugugucuguaaucucagcuacuugggaggcugggguaggaaaaucacuugaacccgggagugggagguugcagugagccgagaucaaaccauugcacuccagccugggcaacagagcgagacucugucucaaaaaaagaaaaaaaaaauuagccgagccuaguggcgcacauuuguaaucccagcuacucgggaggcugaggcgggagacuugcuugaucccaggaggcagagguugcagugagccgagauggcaccacugcacuccagccuggccaagagugugacccugucucaaugaaauaaaauaaaauaaaauaaaauaaaauaaaauaaaaaauaaaauaaaaauaaaauaaaauaaaauaaaauauguaaaauuugaguugaaauagaacgaacuagccuacuccuaaauccuuagugcaugagcugccuccaaggauguuucagaaacaugugaaagucacugcccuggauaacugaauuaccuaaaaaacugacaaaaaauuguuuuaaguauuucuagauuuaagauuccuaaaugguauagaauacugugguuuuuuuuuauugagacauuuaacagcacaauuucucuaagccuuaguuuuucugaacuguaaaaugaugacuuuacacuagaagauaugagggccuaucaacaguaaaguuacgcuaugaugagggcuaucauaaaauuaguggugcugauuucugaauuuugaacacacauacuaugagaguauacauuugccauguccuaagaucuuaauuucaaguuucuguuaacaucuuugcuuuauauuuaaagucuacuauaaauuauuagucauguaucuuuuuucccgaucacuaggaacuagauggaaauauuuuuuaaagcaugucaauuucuuuaucuuuccucagggaagauacguaccagaagaaauguguugaggaaaaaaaugacagcuugguuuagguuuuuuuguuuugccuaaaucugaaagggcauacugccuacagugaguuuagcagggagaaagugggccaaaaugaggaaaagagagagacuacaauaugaauauauucuagaagaauagaaaaauaauccaagcuucuuauuuuauuauuauuuuuuuaaacggugucucgcucuuuugcucaggcuggagugcaguggcacaaucucagcucacugcaaccuccaccuccaggguuugagcgauucuccugccucagccucccgagcagcuggaaucacaggcaccugccaccaugcccggcuacuuuuuuuguauuuuuagcagagacaggauuucaacauguuggccaggcuggucucgaacuccugaccuuggaugaucccccauccccccucggccucccaaagugcugggauuauaggcaugagccacugagccuagccgcaagcuuuugaaguauaguaacuuucugagauaaagaaaauauucauauuucuuauaaaaaucauuaaacguauaauuauuuugauccucuguucuguuuuaccuccucugauuaauuuauuaauuuauuuugagacagagucuugcucugucacccagacuggagugcaguggugugaucucggcucacugcaaccuuuaccuccaggguucaaguauuucuccugccucagcuucccgaguagcugggauuacaggugcgggccacuacgcccggcuaauuuuuuguauuuucaguagagaugggguuucaccauguugguuggccaggcuggucucaaacuccugaccucaagugaucggccucccaaacugcugggauuacaggcgugaaccaccacgcccagcccugauuaauuuauuauuuuaagaauuaguuaugccagaccaggcacaguggcucaggccuaucauugcagcacuuuaggaggccgaggcaggcagaucaacugaggucaggaguucaaaaccagccuggccaacaagaugaaacccugucucuacuaaaaaugcaaaaauuagcuggguguaguggugcaugccuguaaucccagcuacucgggaggcugaggcagaaucacuugaaccuggaggcggagguugcagugagccgagaucaugccacugcacuccacccgggccaacagagcgaguaucugucucaaaaaaaaaaaaaaaaaaaaaaaaaaaaaaaaaaaaaagcauuaguuauacuagaauaaugaaagguaaaauguuguaagugcauuuucaugaaacucaauugcaaaaaauuccaaacuaacuugucaauuaugaagagaauauuuagaaaucacacucuccaucucuaagugcuugauauaaaguuccaaccucuuuauaaugagaaaaaaaaaaaggcaggaaaugcauuucuggauacuuuuuuccuuugugacagagucuuacuauguugucccggcuaccuuugaaauccugaguucaggcaaccuucccaccucagccuccaaaguagcuggggcuauaaguauguacaaccaugccuggcuuuucuguauucuuuuucuaaauaaccuaaaauacugguaaaucauauucugcugcaagugacagaucuuaggcacaccuaaucacaccuguaauuccagcacuuugggaggcugaggcgaacagaucaagaggucaagaguucaagaccagcccgaccaacauggugaaaccccgucucuacuaaaaauacaaacuaaagggcaaccuuuagucauacaaucuuuagguacacaacaaagaaaaagcaucauaaaaucaacaguuaaggccaggcacaguggcuccugccuguaguccuagugcuuuggaaggcugaaguaggaggauuacuugaguugugaaccuuucagaauuuaagcagaguuuugaggaccacguaaaggacguugugagacuccgaaagugucauacaaugguguccuuaaggaccugaaaaacuuaacaguucacccuauguacaaauagcuuauaauuacagagcuauggcuucuuagcagucaaucccuaaagaacaaaugcuuuuugggacagagugugauaguuuacaccucuuuauguucaagaugccuauuucuuuucugauguuaaaugaagaaugaaaaacacugaauuguaacuguugauuuuucuuuuuucuuuuuuuugaggcagggucucacucuguugcccaggguagaguacacuggugugaucacagcucacuugaagucuugaauuccugagcucaagcauuccuccugucuuagccucccaggcaguuaggacuucaggaaauaccaccaugccaggcuaauuuuuuuuuuaauucuuuuuguagagaugggguuucacuauguugaccaggcuagucucaaacuccuggccucaagugguuuuguuaauguuguucucaaaauuuaucucaaguaguaauuuagccauuaaauaaaaauuaaaaguaaauuuuuuaaauuaaauaaaguuaaauuuuauacaauauuaaacauggagaaucacaguauacuauagacaaugauagauuucauagauuucagaugcagcauagcacacgguauaaaauaauuacgaaaauguuagaaaguagauaaaggaguuuauuauggccaggugcagugggucacgcuuguaaucccaguacuuugggaggcugaggcaggaggaucacuugaagccaagaguuugagacaagccuggguaacauggugagaccuagucucuacaaaaaauacaaaaauuagccgagcaugguggugugugccuguagcuccaccuacuugggagguugaggugggagaaacucuugagcccgggagguggaggcugcagugggcaguguucacagccuggcugacagagcaagacucuugucucaaaaaaaaaaaaaaaaaaaaaagccaggcgcgguagcucaugccuguaauuccagcacuuugggaggcugagguggacaaaucaagaggucaggaguucaagaccagccugaccgacauggugaaaccccgucucuacuaaaaauacaaaaauuagggccgggcacgguggcucaugccuguaaucccaguacuuugggaggccaaggcggguggaucacgaggucagaaguucgagaccagccuggccaacaugacgaaacuucaucucuacuaaaaauacaaaaauuaguugggcaugguggugggcaccuguaaucccagcuaguugggaggcugaggcaggagaaucgcuugaacccaggaggcagaggcugcaauaagccaagaucaugccaccgcacuccagcuugggugacaagaagagcaagacuccgucucaaaauaaauaaauaaauaaaaauaaacacacaaaaauuagccgggcaugguggcacgcgccugugauuccagcuacaccggaggcugaggcaggagaaucgcuugaagccaggcaguggagguagcagugagcugagauugcgccacugcacgccaagccugggugacagagcaagacucuguaucagaaaaaauaaauaaauaaauaaagaguuuagaguuuauuauauuuauuaucugucacaguccuuccaaauuccugugcucagaaacuggauuucuugcuuuguaguauuauacuuuaaaauaaacuuaggcucuuuuuuccccguuaacauaauauaguuucaacugucuuuccuccuggaaaaagucaaagguguuuccuguugcauaugccuugauacaucucucuuuggggcauguccuuaauuuuaacucuuccuaucaaagaagaaaccacucauuuggcugagaaacucauugcuucugaaaaggcaagucagaaaucuuucuucauuucagucauuucuggcaaaugagaacuaaagccagcucgagguuuagccccuacuagcuccccaccagcaucagaugcaacuaugaagggaagcuacuuguaaucauuucaaccaaauccaaaauucagagaaucaaauucucuguuccacauuccaacagguccaucaucaugcaguuuaucuuccaaauuaaaacgaugauacucuaagaucaacaucucugcagacauagaaucuaaauugagcuuuacauuauuagcaggagcaauauuuuaagugacaauacucccaaauuaagcuguguggauauaaguauuuacuaauauauuuccccacugauuccacaaauguguacaaaucuuaacaaaaauguauaccguacuagauaaaagucuacucuguuuaacaguaaaaggaacuuuaaaaauaaauuauuuuauuucugaacuaaaaguacaaaugcuauauaacuacuucuguauuccaaauaaaacaugcuuuuaaaaaacugcucugaagaauggaaaaaauuauaaaacaaaacguaucaaccacuuuugugaggaaacccauuacugaagauuuaaguaaucauccugaauaaacaaacaauaaaggaugcaaaucuccccucacaagucaauucuuuugacacagaauuaagacuuuaucaaguaguucauuacugcagcauaucaguaaucuaacaauacauuuaguaaauacauacaguuccagaaaggacaucaugaggacaacaguugagaaggugacucuugcauacucugucaucacugaauuugauucguugacgaguuguaucuccuguaauauagaagaguuaauaacauucaagguuagacaacuggaaaguauuuucugagagcccuacuauuacuagcuuuuuauguguggcuauauacacacauuauaaaucagcucaagagggauuaguuuuuauauacauccuauagaaaaacuauuuuagacaacaugcaguugcaguaaguguacugcauacauaauucaaauagucaaagugagaaagcaaugcauucuguuaaauagaguacuucagaaaagcauaggauuuuagagcaggaauggacuuuaaagauuaucgaguccaacuccuucauauugcagaugagaaaacugaggccccgagagguuaagcaacuugcagacccacuaagagaguuuauacugguauacaauguucccuucuugacacuaagcauugauauauuuuuauuuacaguaauugaaaaacauaaaaaauaaucuugcaaacauugcauacacacugcgaauccccacugaaccccagacgccauuucuuccacuauuuuguuccagcugaagugucucccuuuugcugcugggaggaguuagagaggguagaauaacgcguuuaagagcguacaaaccuggaagaaggacuuacacaccagucaaacaaaggcacauugccuaaugaaacguuaacuuuaaugcguccaaagguuccauaccuccaaguuuuauguagucugagcuuuuucauacugccaaacuggguauauuuaaauucauucugucuucauauaacacaauacaccuaccuccuaagcaacagaagcauccaaccugcuuaucaaauauggcuaucuacucaaaacguuaaagaaucuaagaaaaagaaagguaacuagcuccaauaacaaaauauagauguuaguuaaaauuuuuuugcuuagaaucucuuuggaaaaacaaaagaaaaaacucauuaggauguuuccucuuucuauauagaaugauaagcccuaagaaauguagguguuuuauuuuagccuuaaacugauauauuaucgaugaaugaaaaccuacuggugaauuacugaagcaagaacuauuggugccaaaagagauauaaauaccucuguauuucacaugauaugccuggagcacuccaaaaacuuucguguaggaugugauucaaucacuuaguuucuguauuuucacauguaaauaacaaaaaagauuaaaacuuuaccccuucauauggucauauacuaaagagcuuaacuuaaauucaacuaaacacuaucauuuuuagaugggguaagauuuuguucaaauuguuuuaacgugguuaaagauauuuuuaaaacauucuaauuugcaaccaggguauauaaaauuuuaacaacaguaauuuauaguuaaaaugauagcuucagagcaguucaacaauagguuuucuagaagcucgucucuaguagguuauuuuugacacaauuuggaauauucaguuuaguguuuacgccugcuacuauaauaaaaguuauuuugaugguccuuuuuccuuuuaaacacaacugcuuuuguuccacauucauuaacacaucugaaaaguuagcgauaacucacggcuuggcgaaugcggggccuuucugacacucccuugcagauugagguaggcaggcauagauacauugaaccuuuacaaauaaaacaaggggccagauuguucauuuuguauagaauaaacucugccagcaauuucaauacagcaucuagaaguacauguugacuguaaagauucuuuuauauaaaaacaaaagugaacaaaaucaggguguuucauuuuuuuaaauacugacuuaacaaguauaaccccagauaauuguaugacugacuacagguaaaaguccaaagcuggagcucuggacaaugucuuugagccaagugggguuuuaaaaaauuauuucuuuaaaaaguauguuucaucaagacuuuggugaggaccucaagcucauguuagaauggugcuaugauaaacucauaucagaaugucaaugcuauuuaauuagaagcuuuuugcuuccuaccauuuaagaaaaaaauuucauuuuaaaucuguacccuaauuauauuaagcaauuuuaaaaugauaaaauuuuaaaguugaaacaaaaacaaaacaaaacaaaaaaaucccuuauguaucuaauaagucuuccugcuaaaaguaucuaaauguuuugguaauggcaacagcagaaucauuucagugcuuuguuaaacuaauggcucaggccuuagaauaaaaucaguauucauggaguuuuacuaaucaaacauuucaucaggcagaguaacugauuugugcuuaacaacuuauauucaaauauuaaguuauugugcccugaagacacagcuaucaguuaaaauaugaacaaauuccuaauaggaauauagcaaaccaggcaguaucccuggugagcuuuuuuguguuuuuuaaaauuuuuauggauacauaauaguuguacauauuuucccuggugagcuuuuaagaucagaaucuguuucuauaaaugccaaaaaacauuuuaaaauaacuccucaccgcaaaugaaugggugcuccauaaauauuugauaaccguagcaaacucaacaaauacagcuaucaaauagcagccauuauagaaaucuuuaaaacaaugaaauaauaaaacgcuuaauaauuugagauacagaaauaccuugagagagaauagcaacugacuguuuauugauauuuuuaaaguucugccuuggggacuuuaagguuuacauuuuaaaacaaucuggcugcauaaccaugcaguacuuaacaaauuuauuugggcuuauuccauggcaguacaauucagcuaaaccaacaauaauuuuuaaaagaaaaaugcugguaauuugguuucugucaagauaucuggcccaaaccauguuuuucauaagaaacuagguaaaacagcaccuauuuuauaaaaagaagaaagaacugcaaauaggaaccaaaucaccuuauaauacaagaaauuauuuucaauuuaauguguuuuaucuuuggguuuugugggcauaaagucauauaaaaauaaccuauuaugggggaaaaaguauccugucacaaugacauuggauccaaaucacagaaucaaaccuauuagugacaacaucugcugugcuaggcaauggaauuacaaaggggcauauaagacaagcucucuccccucaaggagccaaugauuuugcuaaagaaauaggacauauuaauuuuuuuaauuuuuuaaauuuuuuuguagagacagggucucacuauguugccaaggcugaucuccaacuccuggccucaaaugacccucccaccucggccucccaacaugcugggauuauaggcaggagccacugcacccggccgaggauauauuaauggaguaauaaguuauaauacaagauaacaugauccaaguaucaaauguguguuucaauuagguaguacuucaggaauucuuagacuaaaauuaccaccaagaauggaaauauuggaaaaagcuucaugcaauaaguagccaaaauuugaaggaaagacaggacuuagaucaaaguaaaguagaaaaaaaagcacuacaaccuggaguaauagcuuugacaaagcuuauaagagcaagaagguuugggggaacaguaaguaaaccauaucuggcuuuggcaaauggcuucauguagaauugcagaguugggagcaaaacaauacuuuuugaguaacauuugauuucuuacauuuuucauuuuuuaauccaaauuuuuaguguauaaaguaaaaaaaaaaaauuaaaauaauggaacagagaucaggcgaaguuacuucugucaacaacaaaaaauaucccaccuauaaaaacauggagaucucucuguccuauaaccucuacaauaguuauucaggccuuguacuuaacuacacagccaaguuuuuagaauuagaaacuugauuuagaacucuagcaagugagguguuuuucauuuuaauagaaacaucaacuuuucuauuaauuccuauuucuaccaaauucucuaccaagcaacaacucucuuuccucccucuuuuguucaacaccuucaugaguuucaugaauuauaaccuuugagaacaccugagucacaaguauacaauaaaaaugaggaugcauauuauucaucuccaggucugucaccaauguaucagagccuaaggcagucaguuccaccagggaauauagacaggucacuuuaaaaagaggccuccucucuaaauuuuacucaaauacugcuauucucaaaauccccuuccauauaucaggagggaaaaaauaagcccacugucauucccaacacugccauucuaugguccugccuuuucugaaacuuauauuaacacuuaaauuuuauuaguaacauuacaaccuuagccuagguaguaucugacaugauuuuauacuuugcaugcuaucuucccaauauccgcccccuccccccaguacuacccacccucucccucccauacaaacaagaaaccaaaucaacuuucauagauuuaggugcuauuuuaaaaacaucaaaauuuuacuuuacccauucucuccgaugcucccuguauuuuuuuaagcugugaguggaugaccaugcuaugugaucaacaacugugaaggcuaagcaaaagugaacugaguuuaguauuguaauuucaaaagaaccuuaaaguuuguaauauuugacauauuuaaugguaugcagaauccuauuucacuguacauuaucaggcauucauggcaagcaauuuacaaaaacaaucaguauuuuguacagaauuagcuuagagcuuagcuuagggaaaacaaggagggaggagaaugcaacagcauacaaagcaauggagacacucccaugucuacaaaugggggcaggggaagggaagcccucccacauucucuaggguggcaacugaagcccuccccacagguauacuaguuaagggucacgugucacagugggcuugggacaggacaguuuccuucccucugaaauaagauccauaaccccucagugaaaggaaagcuagagcuagagagguguacaaccaaaagcuuaaagcuuguuuuccugaccccuugaaucccuaaaugcagagaaacguuccucccucuuuuucccuccauuucuuccaacauaagcugcugaguucacguaauaaugugggaacuguauaaagauccauggccaauuucuagucuaguccagggcaggaagagaucuaaagcagugcacaaguaaaaccuugugucacugggcacaguggcucaugccuguaaucccagcacuuugggugggcaaggcaggcagaucaccugcggucaggaguucaaggccagccuggcuaacauggugaaaccccaucacuacuaaaaauauaaaaauuagcuggguguaguggcacaggucuguaauaucagcuacagaggcuggggugggagaaucgcuugaaccugggaguuggagguugcagugagcugagauagcaccacugcacuccagccuggcucacagagcaagacucugucucaaaccaaacaaacaaaaaacccuugugucuucauguggaaucaaaguaaaagcgaugauuacugcugcacaguaacucuuauacuaaggagccaaucugaucauuuuuacaucuuccucaaacuuucucacccacucuaccaacuucucccaccuaccuuuguuguuccuuuagaauucagcuuaaaauccaccuauacaaauccuuuuguaauuaaccuuuuaaaaaaacauuacucccuugcuacauguuccccuguuaauauauacacucaguuuaacccacuguauauuuaaaccauccaaaguauaggguucauuuuacaaaaggacucaucaccaugucuuaacauaauaauacagaugcuuugaaaacauuuaauaugucuugaucuauguaaaacuuuccaggcauauauuuauuacauaaggaaagggaagaaagaguacuaugccaaagauggcaacgggaaaaaacaauuaugacagucugccuuccaaaugugacaucaagucguuccuaauaaaacaaagcagcuuuccuuuccuccagaaaauguaaacacaagggugcuauacagcucagaaaagcuauccuucuuaaucuucugguucauauggucccauaaguuuauaaucagaaauagguaccaguaucaccccccaccauaauccccaugacaagccaaacauuuuuaaaaugugaugcccacuguagaagaaaucuccagaacaaguucauucuugcuggauaugaucaaagauuaauguuuuuaaaauguuaaaaaucuggcccacuugucugugaaaauccauaucacaagauuauaagaaugaaacuggggaacagccuuguuaguagaagaaaaaccuuguaggaucuuuugaagcuaaccagaauggugaugaugaaaaugugagaacaggaauacuaaagaaucuccauuccaaggcucuauuccaugcccugcaccuaucuucucucauuauauuaauacaagcaaagggucuugguagcuggcagggaccaaugcuaucauguuuugggggguaugugcuuuaggaaaucuaucagccuauuccucuucuuaaauuuacaagagacaucagaaaagccugaauaguuacuuuaacauuaaguccuaaaauagguuauauagaauuuauuuuaagauauauggcauaaaaaguuacagccugcuaaauuuuauauuuugauacuuacuugcagagcuguaauucugacauaguaacaauugcacucuggauagccggugccuucuaucauccagaacuuucuauauacaaaauuagaaguaacgaaagcuaucuuuggcuaucaagcaauagcugaaaauaaucaaagaaaaaguaacuggcugauuuaucuauuaaaaaagacaaguucucaucagcuggugauagcuacagaagccaacuagagccuccccaaauccaaaggaaaagaaauaaaaaagaaaaaaaaagaugaaaauaucaagggacagaggugauagacaacccaaugauaaaggaagaaguuaaaaugaaaaacagaucaccaugaaggagacgugagccuuaaaacuaaacaacacagcagaaauacugccucacagugaauaugcaacaaauuuacaaaaaggguugccucuggggaaaggacugagacggugaaggggaccacaaaagacuuuauuuguaaugcuuuaugcacuuuuuacuuuuuuuuuuuuuuugagacggugucucacucugucgcccaggcuggagugcauuggcaccaugugggcucacagcaaccuccgucuccuggguucaaacaauucuccaaccucagccucccggguggcugggauuacaggcacccaccaccacaucuggcuaauuuuuauauuuuuaguagagacagguuucaccauguuggccaggcuggucuugaacuccugaccucaggugauccacccaccuuggccucccaaagugcugggauuacaggcgugagccacagugcccggccucuuuauccauuuuuuaaaauuugacagaaauauacgaaauaacauuuguucaaucauacagaugcuuguuugaccucuguacuuuuuaaaacauuuuuuuaaaugcagacaccuauaaucacuaucacagaacuuauuacuuaaaaauaaacauucaaguguaauucuucauucccauuagauuuuuggucaaaagaugacagaagcaaauuaugucuauaaucucuaagaaaaggaaauaaagauauaacuaaagcaacucugcaaccuggguaucaaucuauugcuauaaauaauuacuauacccuaaagcacaucaaccaauaaauauacagaacaccaugugcagggaagcacucccucuaacacaauggaguaaauuaaauuguaacaggaaguuuucaaaauauuuauacaugguguccagacucacgugaaucgacugcuuaguccuagcaacaugcccugccgcucugcucccguccauaaugcaggcucacagccacuuucccuagcauuucuaucaggccucucuuugauaagcagcuuuucccacagccagguaccucuucacauucccacuguggaaccaguuggugaaauccugcagaaacacugacccccguggaccaaagcacuaacggagaggugagaaauugagcuaaaugagguaauuucauccuggaggucuugauggaccucucuagggaucuccuagaucucucugucucacaggcuuguauuucuguccagucauuucugcuuacaggcuuagguauauauauaguucaaacagcuuuccuuucacaugaauacucccuggaacaguaauuuccaaaguaugagauuugcacaaaagaugacuuuagguguuacaugauuuugccaacaagacauuuuaaauaccacucaguaaggaaauuauuaaucacaauuaagucaagaaaaaaaguucccauuuugcaacaguacuuguuuaauaaauuuaacaacuucuaauuuuuagcacaggaacccuaagugacaagagucuaguuacauaauacaccauuuuguuuucauuguauuuauuuuuauggugguauaaacuuucauuuuaaaauuaacuuaaaauuuuuagaaagugaguugacauaaaggaaaauauuaaauaaacagaaaacaguaaauaauaauaaaggcaaggccaggcauggugguucacgccuguaauaccagcacuuugggaggccaaggcagguagaucacuugaggucaggaguuugagaccagccuggccaacauggcaaaaccucaucucuacuaaaaauacaaaaauuagcagggcaugacagugcaugccugucaucucagccacucgggaagcuaggguaaucgccugaacucgagaggcggagguugcagugagccaagaucaggccacugcauuucacgccugggagacagagacucugucuccaaaaaauaaaaaauaaaaauaaauaauaauaaaggcaauaagugugacaaacauuugggaaacacugaucuagaagaggguuucucaaacuuuuaauguguaucagaaucaccuggaagguuucuaaaaacauggauugcuggggcccauauccagaauuucugacucaguagguggguccaagaauuuauauuucuaacaauacgacgugaugcugaggugaugcugaauugcugcuccaaggaccacacuugguuuagaauaacuaaaccagaauggugaucaacaagcuuuuguuagagucaaaugguaaauguuuucgguuugcgggccauaugacucuguugcaaccauucagcucugcugucguaagccaaagcagccauagacaucauguauaugaaucggcauggauguguuccaauaaaacuuuauuuaccaaaagcaggaggccauagugccagucccugaucuaaaacauaccuucaaguaacuuuaacuauuaaacuauuaaaguuacuuuaagagaaaagucuaccauuuaaacuaauacuagagcacaguacagaacagaacagccagguauauuauagauacuauccaauaauuaucaguuaacucuaaaagagaaaacuggggucugcagaaaucuaagguauuaagauuaaaaacaaaaaccauuuaccauauucaggagacaagauucagcaagggcagcugguuaaauuccuuucauguugagucaaauaagucaaacaucaguuguacaugguucacaacuauacuggaacauaugggucaauacugagugcuuuuuggaaagaaguuuuaaagauucuuuucuaugcuaauagcaaaauaugacauuuauucagcugaauggacuucauguuacuuucugacggcuuugacuucucaaaguccuaaguuauucaguucaaacaaaaacauggagcugcagaugauuucagaguuuucacaaauuaauuucucuauauccucaauaaucuugcaaaacugaacaacugaccuauuuuggcccugccuuccaauaucuauucuagcagcugcuagugcaugagaaccuaaacaaaaaggaaacagaauagcuuuucugcaaguuuugaauucacaagauucccucuucacucccucauucuuuuuccaguaagauguuccaacuuccuucaccuucuuauaguuucuuaguagauuaaguuaugccaaacugcuuguuuccucaagaacucuacauacuaacagcaguaggcuuuaagaauucaguccuuuucaagcaccuuucuggaauuccaucuuuggggaguaucugccucauuuaacuagucuugcccacuuauugaccuuuaguuuuaaaccaucugccugucuucucaacccuccugcuugcugaacucacagcaacuuuaagcuucaaugcuuuguaugaaccaccuguuacugaagaguaccugauucacuaaaccugaccuugauccaugacaccucauggccauugaauuccuacuacccaucuugaacacguugaacacuaccaucuauccuuauaugacaacauccaaccuaaacgaaaauaaaagaauuuacuugcuccuuauagaacugaugcagaaauagacaaaaugauuuuucuuuguuuugcuuauauuuaccugaaguaaaagaaugucucagaagcauaugcuuacuugaggagaacuaaacaacuguagagaauccaggaacgaugcaauguuauaugaagugauacuuuuauuguuuucugggcugcuguguagauagaaauauuauucagaguucaaaaugcaaaaugaggaaaacuuuucuuuuuucauugauucacuaugcaggugcuuucaguguuuuggauaugccugaaacucugauaaaguuaaauaguuaacugaaacgcagagaaacuacuguuuaauccuauaaaacuccuuauauuaaagaauuuacaagcucuagacuaagaaauauccuguuauuauuuaaaaaaugucugcguauacauuaaaggcuccgccuccuucacuuaaaaugaacaauccaaguggaauaaaagaauggcucacaacugaccaagaaaugaauaugguucauuauguuaaugagaaaaaauuaagagaaaauguuuucaauguugaugaaaagucaaggaacacagauuacaguaaagaugauuuuauaaauaaaauccauuaaagaacgcacuacuucaaacuuugauucaguaauuuugcagaaaggcagaaaugucauacuaucuuacagauuacacgguuauguacuacuaaccuuacauuagcaacaaguaaauggcuuucuuaacaguauuuuccuggguaugaggaugaguauccuuucaguuuuauaucccacaaacuauaacuacuguacaacugaucagcaaaaauauuaugauuaauauguuaacugaggaaguauauccuacaauuuagaaagauuaacauuuaaaauaguuaaaauuauugaaaguuuuaacuugcccgaaacagucccuaaccauaagggacaauuaaugaugcuauaaaauucuaucuaacauuccuagucuacuuguuguuuuggagggcaggcugccauuccugccuauuuuaaucuuucgaagguggucucugcucccauuuaaagguauaagcaauuaagagauacagaacccucagaacuaccuucuauaacuuaccuaauuucuaagcuuaaaauguaaucuaggcugggcaugguggaucacccgaggucaggaguucgagaccauccuggccaacauggagaaaccccaucucuacuaaaaauacaaaaauuagccagacguaguggcagccaccuguaaucccagcuacucgggaggcugaggcaggagaaucacucgaacccaggagguggagguuguagcagugagccgagaucgugccacugcacuccagccugggcaacagagacccugucucaaaaaaaaaaaaaaaaaaaaaaaaaaaggauguaaucuaaauccacacccucaauuuuauuuaauucuuauugcuugcaucuucccagacuuuccugggaucaagacuagagacuuaugaccaaacuguguuuguuggcaaaggggcuuuagcuaaggaacauccuugcaauuaauccaacugagcaaaaaucacagucugugugaggguacuggguucuuccaacugucacacagacaauucucaaacuguuucuuggauuuuccugugcaacuccucccugcuuucaaauagaaugaauauguucagggaaaacaaauuaucccucuccccucugcuaacaacuaaaacagaaagauauuuauaaaacguaaugaaucauaaacaagauaaaauaaacuaguaauuacuaucuacuuauagcuccuuucuaaaaaaacuuaaaauauauuuauuuuucaacauuucugaguauaacauaggaaauuauuugguuucccauauaacaaauuacagauuuaacuugaggcaaaaaagguuaagugacuuacccaagguuacaauuagagguacagcuggggcuagaaaccaggucuccugagucucagcccagugcucuuuuccuuagcccaugaugccuuaucagaaaaauccaaauacagucagacccccaguuauauggguaugaguuacacugauucacauauacaaacuuuauauagugugaccaauguuucaacucacgcgguacccugcuuccauuuaugcaguaugccaggcaucggcacgauuuucaguggcacacaggcgguugccaccaccagggcccuaggcaaaauugcaaagaaggcagaguuugucuuuggcccucccaccucccuuaugcauuucucucccaccuccuggcagucccccugcccagccucccggcaccaucaugcugcccucagauugucuaaagcccccaacuuccaccacucacccaggaauguccuuucuugaagugcccagugauccaaaauuaccucuccauuucccugcuaacaaaauuccuacuccuaaggauuccagugaaguuuagguaaucuaaaugauuaacuacuuuauguaauucaaguuaagguauauuuaacuaacagacuuaaaucuccaaugaauuuuaaaaggaacuaauuaaaaacugucaggaaggggagggggaagaaaccuugagggggugaggagguaauguuuucccaaagccccaggacucugugccacuucagauuccuucacagacaggacacuaagaguggagggggucacugccaccuugaaccccacuuccaaaaaagagagucgcugcuuuauagucucuggaauuaaaaaaaaaaaaaaaaaaggacagaguugccuuaaauacccuccuaccuaccuuuuccaucucucucccaccuccuggauacccauuuccaccucuuagugccaaagacacccaacagcguucccauaggcuguuuguguguccaauacaaggguucccauuaaaugguuucaaauuacaugguguuauucaggggacguuuccauguuccccuaucccuggguaacuugaaguugacuguaugcuaaaaaagaacaauccuaauuauuaaaaguccugaaucauaaaaugauauauauaaacucauuaaaugguaagaaaaaaaagaauguucugauuauuuugcauauauagaauuaauuuugauaucuaaaaaaaacuccacucaauuauuuuuccuugaaaguaguauauuuuuuacuucuaacccaauacagcagugaaaauccagucauuucagcuaaacaauacuguggacucguaaauaugaguucgaucauaaauccucuaagucugaagguuaaaaaaaaaaauccaguaacagacacauaaaaaaauacacaaaguggauuuuaagaaauccauguuucugcugacuacacacacagaaauauauauauuuaaauuuagcuuugcaauacuagacgggcugccuaauucagaaacuuaucaggagaugguuuaccuugauccaacuacccucccaguaaaacuaagaaauccaauccaugaagaagaucccaaaaaugguauccaucaaggauuaaaaggaucauguaaagcacgucuuaaauaacuuaauuuuauuacacagauuaguuauucuguuagcuaggauccaaugaaacccguucccaauacccucucucauguuggaaaaggaggaauguuaagacaugcugcagugauaaaguaaccauucuuaucuaaacgugagaaaugauaacaguuaaaaguuucuccaguggcauuuuaaguuaauguuaacuuuccauacaaaacucauuuccuucccaaucuuuccucucuacacaaccacaaguagguuugccaucuacaccuauuugucuauauauucuacaaauaaaaguucccaauauggguuuuuauuaaaacugaaaaugugaacacugaaaagccacucuacgcacugcugaaagauuugaaugcaauaaaauuuuuaaaauuuacucauauuuugcuguaaagcacucauguaaauuaaaagaguaacuuaaaaacuaaauuuaagacgugccuuuucucuuaaaucaauacacuuaaauaacuucucaagaaaaaaagcauuuccuuaguggcuaagaaacuaucugccuaaagaagcaacacauaaaaacuaccaaggauuuugcuguguuaagaaaguaaugaacuagaccuuuccuacauauuugaauguauuuaaguugaauuugagaguacauuacuaauuaacaucaccaaaaaagcaacagcauuucaucauuuuauuuagaaauucucuuuaugacaaaggauaauccagcaauuaagggcucucuauacagauucuaaacuaaacgccugaaaggaucuuuguucuccucuauucuacuucacuggguaccaaauuuucaaaaucguucuguuagggacaugcaacauuugucaauauuuacugaacaaagccucuauuaaauugucuaacaaaauggaggucucucggaaaaacaggccauaacauguuccuucucacaaaauggggccaaacacacccacuuaagaaaccaugguuugggucagauuuuccauaaaaaugguuguuucuguggggcucgagggugcaucucugagacuggguuaguaauaaagguuuccuccugacccaggaagaggagggggaagcuucucucuagguacucuggaggacggcggcgagggaugaucccaaagcucuggguuaaggaauuauaucggggguggaggccuuagcuuuccgcagguaccuaaccagcgacaaaacgggccccccaacuacgcaacagagacgcgggcucucccgucucagccaagucaacauuaaaagcacaaacucuccuuucugccuccaggccccgccucaccccauuggcagcaguucccgccaauccgcauggucaccgcccccccugcccgccugccgagcccugauuggaugggacgggggacggggaccucguguuaccaaucugggagccccuuacucagccacacgcgcgcgcccaggugcgcccucggaaccccuucccuucgccguccccguccccucccccacccccagggcccuggcagagacuuaccgucccgggaggugcccaucaacugguccagcaucgcgcgcaucugggccugcgccgacauggcggcggcguagcgggcggacgggcggggguggggcgcagaccgggcccuuuugggcugggggauaaggggaagggaugggggaaggugcgcugcugucucgguggccgccgccgccucgaggcgugcggaaagggagccggagggguugcgggaagaguccggacugcgcuccucacgacgacguguacguggaagacgacagcccccgacagcgacccucgugcccucacucuccguccgguucuugggacagaagcgacacgggccaagcaagcucucgccuucaacaccgccacccgccagaagccgucaacccccccucaagcucugacgccgcucgccgccaccgucgccacgacgggagcgcgcacgcuccucgcgcucagucguuucccgcgggggcuccaccaacuggcguccagcuguaucacuccgcccgccccgcccgaguggaguuccacccuaacggcucugggcgcgugcacgcgcgcuccucccgccccuuuaccccggaucucgcgauacucugguuccuuaacugacugugcaagccggauccgccccgaggcgccaaaccuuacauuacauucccucccggcuguagggcuggcggcuaaggcugcgcugcccgcggugauggcgauucagacccaaauuagcaaaaugcgcuagagguuagccugggcggaaaguaaguagagaccaugcccaucgucgaccggacugcggucagccuccuuggcgucugaggugggcgugcucggggcgaacgcccgccccgaguggcguggacgcguccugguucucgugcgccuuucccggccgggagcaggccugucucgccgccgccggggccgcguuccuuccgcugcguggggcuuuaaggcuccucggcugggaagugucaacuucaggagaaagcgcccgaaagcaguacccuaggaaacaggcgcgccgacccauucggauucaucuuuaccuacaaggucgcgggcggcuuagucugaaugugaaaccauaaaaacucagcguauucucagcuacuggggaggcgaucucggggagcagggagccagcggcgcuggccgcagggaagccuggauucugaagcccggcccgugacuggggccuuggcuucaguucuaccccucguagggcugguggagguggucacacgucugcuauggcguggcuguuagaacaaacuggaauaaaauacuuagcccugagccuuucccugguguuucuaaaaacuguuuuaguaaaauauuaauuccuugccgggcgcgguggcucacgccuguaaaccccgcacuuugggaggccaagggagguggauugccugaggucaggaguucaagaucagccuggccaacauggugaaacccugucucuacuaaaaauauaaaaauuagccgggcgugauggcgggcgccuccccagcuacucgggaggcugaggcaggagaaucguuugaacccgggagacggagguugcagugagucgagaugacgccacugcgcugcaaccugcgcgacagagcgagacuucuaaaaaaaaaaauuccuuaaguaagacauaggucagugugcaggaagaaagguugcuuaaaaagaaaucuaaaacuguaagaaaaaugaaugaguuaauaaaaccaaauguuuaagaagacaggcacuuucuagauacuuugaaaggacauaauagagauuuguguuccauuaacacuguauauucaucgccuaaaaagaaauuuaaaacuguaagaagaaugaguuaauaaaaucaaauguuuaagaagacaggcacuuccuggauacuuugaaaggaaauaauagagauuuguguuccauuaacacuguauacucaucgccuuggaacuguuauuagcagaucaauaaaaaacaugaauaguaguaauagucccaaaauuccuuuaaauguauauugcggcugggagggauggcucaugccuguaaucccaguacuuugggaggcagaggcgggcggaucaccuugaggucaggaguucgagaccagccugaccaacauggugaaauuccaucucuacuaaaaauacaaaaauuagccgggcauggaugcgcgugccuguaaucccagcuacucggaggcugaggcaggagaaucacuugaacccgggaaguggagguugcaguaagccgagauuaugccacugcacuccaggcuggguacaaagcaagacucuaucucaaaaauaaaugcguauugggccaaugaaaauuuuugaggucggacgcaguggcucacaccuggaaucccagcacuuugggaggccgaggcgggcgaaucacgaggucgggaguuugagaccagccugccaacauggugaaacccugucucuacuaaaaauagaaaaaaugagcugggcgugguggcgcaugccuguagucccagcuacaccggaggcugaggcaggagaaccgcuugaacccaagaggcggagguugcagugagccgagaucgcgccauugcacuccagcccuggugagugugagacuccaucucaaaaaaaaaaaaaaaauuauuuugaaucaaguuaucuuuaguaauacacaaaauagcuucucuucaguuauucagagaacucugaauuccaaacuccaaauacuaggauauccuuugggaacugauuuauaauaauagaaaaaugugcaaauuaauaugucuuugagggauacacuauuauguacacaaugugaucugacccugaaaaacaguguauuuaaagaaauacacuaaaaccaauaauuauguuuuguugaagagauuugaguucuuuuuuuuauuuuagaugucuuauaaacagcauauaauuggggcuuaaaaauagucuauacaauacauaaugaucaaaauugaggagugaaauugaggagugaauuaagugauguucacucuuggaagcauugaugauuuauauucauguaauuacuccuguguuuggguuuaaaacucuuauuuuugccuauuugucucaucuauuucauguuuuucucuccuuuccugccugauuuuuaaucauuccaauuucuuccacucuaguaguguggaaguuucauuuuauuauauuuuuauucuuucagugauuacccuagaaguuauaauguguauccuuaagguaucaaagucuaauuuaaucaauaccuuuauacuccccucccccaagagagguaauacaaggaaccuagaacacuaacuccauuuacucucaucccaaguuauaugcucuuguuaccaggucuuuuaguucucuuauuuuuuaaaaccaaguuuuauauaaucaauguucuuuauuuaccacuuauuuugcucuucauuccuucggaaaucucugccuguccaucugggaucauuuccuuuuugucugaaguuuauccuuuagcacaggagucagcaagcuacgguccacaggccaaaugcagcccacggccuauuuuugugaauaaaguuucacaaaaauucgaauacugccaggcucguucauuuacauauuguugugguugcuuuugccccacaauagaguugggugguuugugagggaucccauacuguguggccuacaacacucaaauauuuacuaucugacuuuuuuuuuuuuuuuaacgcagguuuucaccauguuggccaggcuggucucaaacuccugaccuuaagugauccaccugccucggccucccaaagugcugagauuaccagggugagccacugugcccagccugacuaugaaguuugccuaccuugcuucaggguuuguuuuuguguuggucggcuaguugggggaacgcucccauuuuguuuaucuaaaaagaucuuuauuuugcuuuaaauucuaaauggauauuuuuauuagcuaaauccuagguuggagguuccuuuuuuuuuuuuuuuuuuuuuuuuuuuuugagauagggucuugcucugucacccaggcuggagugcaguggcgagaucucgccuuggcucacugcagccuuggcuucccgggcucaagugauccucccaccucagccucucaaguagcugggacugcagguaugcaccaccacacugagcuaauuuuuaaaauuuuucuuguagagacaaggucucccuauguugcccaggcuggucucaaacuccugggcucaagcaaucugcccaccucagccuccugaagugcuggaauuacaggugugagccaccacgcccagugguuauuuucuuugggcacauacauucuaccuaaccuuuuaccuuccacugcuccuaagaagucaguucuguuuuucacucuuuuaaagauagcuggcuacuuuaucaugccauuauggacucauugaacaaugaguuuucauucauucguucauugagaauccauuaacuaacaucuuuugucaauuuaggaaauucuuagcucuuaccuccucagauauugccccucucaucaacuucuggacauuuaaauacaugcauauuagauaguuuucacuguauccuaucucuuuacucucagucuugcacuuuuuaccuuggucuuucaaagccgaugccuuuuucugacaaauuuuauaguucauuaaugucacuauggagcuguaucuaauuuguuguuaaauccaucaguugaauuuucaguuguagaauuuguauuagguucuuuaucaaaccuauaaugucauuuuauaguuccugguucccugaugaaauuuccaagcuuggcugcuucuuugaccuuagugaacaauuguuguguaaucugaguuggccaauuauaguaucuuaagguuuuuuguggucuguugcucauguugguucucacauaugaagucuuuucuugugugccugguuuucuuugugugcuaaacauguauuuguaaaaaaaaaaaaauguauagaaauaauauaagcccuaaguauaggauauaauccugucuuccuccagagaggauuuuuauuuuccuuuuuagguaacugaagagauuacuagucaggaaccaccauaauacagguucaaggccucauuuucucuugaccaacaaacaacaaaaaucugggcggaaagucuggcaaggaggcugggugggcaccauggcucacaccuguaauccccacacuuugggagaucuacgcaggagaaucacuugaggccaggaguuugagaccagccugggcaacauggagaaacccugucucuacaaaaaguacaaaaauaaaaauuagcagagcauguugugcgccaguaaucccagcuacucagaagccugaggcaagaggcucucuugagccccauguggucaagacugcaaucagccaugaccuuacuacugcacuccaaccuggacaacagagcaagacccugucucaaaaaaaaaaaaaaaguccagcaagaauuuuuguuuuauuuacuuccaauucacuuuugggauugaauuucaggguccuagcuuaaagugggugugauuuauuagagucccuaccuuugugagccaaaacuuuuuuucucucaguccuauagcucacucaaagugcagcucaguuucaauacugaagcuauuucuaccaaauugacaaaugcuggcaggguauaguggcucaugccuauaaucccagcacuuugggaggccaaggccaguggauaacuugaggugaggaguucgagaccagccuggccaacauggcaaaaccccaucucuacuaaaaauaaaaaaauuagccaguugugguggcacgugccuguaaucccagcuacuccggaggcugaggcaggggaaucgcuugaacccggaaggcggagguugcaaugagccaagaucgugccacugcacuccagccugggugacagagagagacucugcuucaaaaauaaauaaauugacaaaugccaucaugccagcaaugugucuuugugugcuacgcuacuugucuugguugucuucuccuauguucugacccagcauuucaccacuaguuuuauuagcucuuuaaugauuucaagaauuuaaaaaaauuuugacuuuuguuccaauugucuucaacagaagggucacuccaaauuaccuagacugccauuaacagaauuggaaguuuguucuccuguuuguaaauuuuuucaauuuuuuuuuuucugagaccgagucucuauugcccaggcuggagugcaguggcgugaucucggcucacugcaaccccugccugccagguucaaguaauucuccugccucagccuccugaguagcugggauuacaagugccagccaccaagcccagcuaauuuuuuguauuuuuaguagagacgggguuucgccauguugcccaggcugguuuugaacucccaagcucaggcaauccgccugccucgaccucucaaagugcugggauuacaggcgugagccaccgugccuggccuucaauuuuuuuuuguuucuuuguuuuuuuuggguuuuuuugagauggagucuugcucugucaccaggcuggagugcaguggcgcaaucuaggcucacugcaaccuccaccucccggauucaagugauucuccugccucggccuucugaguagcugggacuacaggagccugccaccacgcccggcuaauuuuuguauuuuuaguagagaugggguuucaccauguuggccaggauggccuccgacugcgugauccacccgccuuggccucccaaagcaaaaauuuuaaguguaguaaccauguauucaucuuagcaucugaaaaaaaaaaucucuguaugucuaugucuacauuuuagcaaugauaaccauuccucuuccaggaacaaggucucagaggguaacaaaauaauauaaaguaggauuaaacuauacauuuaaaacuagguaauuaaaacagaauagguacaaguaacauguuuugcuagcuguccagaacagacaacccuucaauuuauuguaauuuaugaacuaaauaugguaaauaaaggcuauaucauacaaauuaauauugcgguuuuacuuggggcaucgguacauacaaucaaauuuuauaaacauggugccuauuaauuuuugggacagucuugcucugucacccaggcugaaguacaguggcgggaucuuggcucacugcaaccucugccucccagguuuaagcgauucucugccucagccucccaaguaggugggauuacagguaccuggcaccaagcccagcuaauuuuuguauuuuuaguaaagacagaguuucaccaugcuggccaggcuggucucgaacuccugaccucaggugaucugccugccucagccucccaaagugcugggauugcaagcaugagccaccgugcccggccggugccuauuaauguagauuuuaaaauucaaauuuuuugaaaauuacuaucuuuuaguuggauaaauuaaaacuuacuuuacagacugccuuggauuagccugccuuuaguucagagcaacacagauuucuuuucccaccacauaauccuaguaugugaacaucuuguucuuaucacauguucauauuuguaucucuaacacuuaaccagacaaggaacucaauacuuuauagccagaaacauccucaguucuagugaaaauguauuaauaucugaaguuuguggagaggagaaaugacaagagccaaaccuaaaccaaaagaacuaguuaauugguuuauucaagacaggggaauuaaaaucaguaagcauauaaacuauauugcuugaaagaaacuuuuuaaaauaauuuauaucuuugagauggggucuugcucugucacccgggugaaugcaguggcgcaaacauggcucacugcugcagucucaaccucccaggcucaagggauccuucuaccucaguguccugagcagcuaggauuacaggcaggugccaccaugcccagcuaauuuuuuuauuuuuauuuuuguagagaaggugucuccuuauguugcccaggcuggucacaaacuccuggccccaagccauccuccugccucagccucccacagugcugggauuaaagguguggaccaccaugccuggcuuuucuucuuuuuuagagauggucuuucucugucgcccaggcuggagagcaguggcuaugaucauagcucacugcagccucuaauuccugggcucaagugaucuuccuaccucggccuccugaguagcugggacuaugggggcaugccaccacaccuggcuaauuuuuacauuuuuuuuagagacagggucucauuauguugcucaggcuggucucaaacuucuggccucaagcaguccucccauccaggccucccacugugcugggauuacaaacaggagccaccuccccacauguuuaagagugaaaagguaaggguagcuaaggcaguaucacccauguaguaggcauucauacauccuuguugaagaaaagaaagugaaauuuaaccugaaauccugaagaaugaauaggaaagagcuauugaaggggaguaugauuggaagaagagcuuucccuguaugaggaacagcaaaauguugaaaucaagaccauggcucccaauaacugaauuucuguauucaguucuagcuggacugucaaacacagagaauagagaugaagcugaagaggucuggcaagggccaggcccuggagguucuuguuaaagucuuucuuugaaggguucugaguagaaugacaagaacagaucuguguugcauaggggaaaauggacuugaagagagcauaauuggagguaaaagggaccaauuagggagggcagugguuaagggaagagauguaagaggucuacacuaggauagcagcaauaaaaauugaagggcuuauuaggagguaaaaucugauuuagugauuguuuaacugaagauaugaaggagagaaagcaguaaagaauaacuuagauuucuggcuucagggacugagugaaagugucauugaacugauagggaauaccaggagagauuuguaggggaagaugaggagguuccauuucgcacacauugaauuugagauaacugaguuaucuaaguggugucauccuccaggccguuggacauacaggucuucagcaugccagaggagccugaacuggaguuaucaagcauuuugagaauaauugaagucaugaaaguggaggugaucacucaggggaaaccauguagggugugacauaaggaccuuggucuggacccugaggaauacccaacauguaagggauacacagaacaugaaacugaaaaaugacuagaguaagaaaaaaacagaagaaugugggccaggcgcaguggcucacaccuguaaucucagcacuuugggaggccaaggcgggcaaaucacgaggucaguagucggagaccagccuggccaacauggugaaaccccaucucuacuaaaaauacaaaauuagccaggcguuguggcgggcgccuguuaaucccagcuacucaggaggcugaggcaggagaaucacuugaacccagaaggcagagguugcagugagccaagaucgcaccacugcacuccagccuggcaacugggcgagacuccaucucaaaaaaaaaaaaagaagaauguggugucaucaaagccaagggaaaagcagggaauugcccauagugucaaaugcucccuagacaacaaacgagauaaaaaauaacuaagauccacuggguuugguguccugaaggucaucuguaccucuggguugcaguuuuggugguaguagaggggcggaaaccagacugcagugcauugaggaugaguaaguggugaaaaaugcagaaaauggauacauaacaacaacauggauuacuaacaagauaagguggcugggugcaguggcucacaccuguaauccuagcacuuugggaggucgaggcggguggaucaugaggucaggagauggagaccauccuggcuaacacggugaaaccccgucucuacuaaaaauacaaaaaauuagccgggcgugguggcgggcgccuguagucccagcuacucaggaggcugaggcaggagaauggcgugaacccgggaggcggagcuugcagugagcagagaucgcgccacugcacuccagccugggccacagagcgagacuccgucucaaaaaaaaaaagauaagguuaaggcucaaaaucaguaugcucaacaaaagaagcugccucaaaagacugcauacuguauagcugcauuuagauaaaauacuggaaaagccaaaucuauagugacaacaagcaggucagugguugccgagaccagguguggggaaggagaauugacugcaaaggggcacaagauaaccuuuuggggugauggaaauguuacauagcuuuacugggauauuuaugacacagguguauucauuugucaaaauucauugaccuguacaccuaaaaugaguauauuuauuauauguaaauuuaccuugauacaacuuauuuuagaaguuucaaaaauacagcaagugaauauaauucauucaagucuuugaauacguuaauucauuugugaagaggaacagcggguaguagcuguaaaagcauuugagauagaggcagaguaguuuuuagaaggaaaagucuuaagcauauuuaaguacuauuaaaggaaaauccgguggggggggggggagcaguugacauuaaaggagguaagcaagagacagcaaaaugaaguaaaucacuuaucacuagugcuuuaucacuuaucacuagacuaguaaccaaaaccucaggauucucaggcugggaccuuccaauuuagaguuuacugccaauauaguuuguguucuagaaucaauucuuucuaacaccgacuucagcugauuauugauggugcgacuaugaauaggagguacagguugguuauaugugaacagaaauggccugaguaaauuauuuaaaccuuaauaacauaauacgcauacacuucugaagacugauggcaguagggcuuagaaaaggguucaugauaaaaggaaugagaauaaaguaaaaagauaaaaacaaacaguaagauuuucucuuuguugaacacucauuaugcaccaugcaagugucugauuuuuuuguuugcuuguugguuuguuuccgagacacagucuugcucuguugcccaggcuggaaugcaguggcgccaucucagcucacugcaaccuccgccucccggguucaaacaauucuugugccucagccuccaaaguagcugggauuacuugcgugugucuggcuaguuuuuugcauuuuuaguacaaacgggguuucacuauguuggccaggauggucucaaucuccugaccucaagugaucuaccugccucagccucccaaagugcugggauuacaggcgugagccaccaugcccagcccuaaguguuuuauauaaacauuauucucaauuauuacaacaaccuuguuggccuucccauuuaauauaaggaggaaaaagcacaggucaacuaaccugcccaagaucacaaaucugguaaauuauacaaguagaaucauaauauaaauauuuuuuuuuuuugagacggagucucgcucugucaccaggcuugagugcaguugugugaucuuggcucacugcaaccuccaccucccggguucaagcgauucuccugucucugccuccagaguagcugggacuacaggcacacaccacuaaguccagcuaauuuuuguacuuuuaguagagacgggguuucaccauguuggccaggauggucucaaucucucgaccuugugauccaccugccucggccgcucaaagugcugggauuacaggcaugagccaccgugcccggccuaaauauuuauuuuuuaacaaucuaaaucuauaugacuucaaaacuguaauauuucuuaccauuagacaauucugccucaaaucucuucuugaaaaauaauggccagacaugguggcucaugccuauaaucccagcacuuugggaguccuaggugggaggaucacuugagcccacgaguucaagaccaaccugggcaacacagugagacccccaucucuauuaaaaaaaaaaggaaaaacauuauauauuauuguauauaauauuguauauuauaauguacauauuauuguauauauucaauaugguaacaacaaaggaaaucaaaacauuaaccuauccucacccuuuugcuuucuucacucuuaccaaaguaaaauaucaguauuaauaacaaaccugcauccaugaaauaaaacagagaacaaauaaacauaugucagcugggcaugguggcucacaccuguaaucccuacauuuugagaggcccaggcgggcgaucacuugaggucaggaguucgagaccagccuggccaacauggugaaaccccaucucuacuaaaaauacaaaaaugagccgggugugguggcaaaugccugcagucccagccacucaggaggcuaaagcagaagaaucacuugaaccugggagacagagauugcauuacuccacuguauuccagccugggcaacagagugagaccuugucucaaaacaaaacaaaaaagguauguuaaacauuucuuuuuuuuauacauucagucgaauaaaugcuuguuugaccuauuaauacuauuauuuuaauguuaaccucuuagaagagaugguguuuugaauggccuuuuuuuuuuuugagacggaguuucacucuuguugcccaggcuggagugcaauggugcaaucucggcucacugcaaccuccgucuccuggguucaagcgauucuccugccucagccuccugaguagcugggauuacaggcaugcgccaccaugcccagcuaauucuguauuuuuaguagagaugagguuucuccauguuggucaggcuggucuggaacucccaaccucaggugauccgcccacaucagcuucccaaaguccugggauuacaggugugagccaccacacccggcuugaacugcuuuaugaauaguucuguugagguuguaccucuccuaguggagcuaaguuauguauucaaaaacauuuaauacaugcaauguguaagucacuguggaaggugcuuuggaaacugcaaagaugaaugagacauaguccccgagaaaagagguuaucuaccuaccagaagaaacugacauauaccauaaaggagccaaagguaaauaaguguuggcaauucacagaaagagaacgauuuuugaggaaauaaggauauaagaagcaaauagacccuuuaggagacuauuuuauugguucagccaaaagauucucagugcuugaacuaggacagaggcaguggagacagacgaggagaagguuauuagagcuacugcagaagcugaaauugcuaaauaauugugaaaaauaaggagagaggaauaccaaaugaagcccaaguuucugucuugguuagcaagugcaugguggagcuauuugcccagauagggaguucaagagaaggaacaauuugacaagauuaggagacagaaagagaugucuauguacucauccaucccucucuguggguuauagcugagcuguggccauguuccucagccuaagggccugcauuggucaggccuagggagguuagaacucucuaguagagagucucucguaaccuauucugguucaggggcugcccaguuaaaaauaaaauauaaaaagaccucucuacuauugagaaccccuaagagcuucaccaucucaaccuuaauucgcccacaucuuuauguaucccuuuaacucuccucaaugucccuauuugagugugccaccuauuuccugccaggacuguaacacaucaaauuuauguauuuuuaaaugagauauguauguauaauuguauauguguaggaaauaucuggaaagaugcacaucaaacuguuaguaauagugaccaccugguaauggggacaagggaaaaggacaaaggaaaagaggguuucuuuuauuuuauguuuauaacauuugaauuccuuaaacaaaaggcuuauacuaauuuuuuuuuuuuuuuugagacagaguuuugcucuuguugcccaggcuggagugagugccauggcgcgaucucagcucaucgcaaccuccaccucccggguucaagcgauucuccugucccagccuccugaguagcugggauuacaggcaugugccaccacgccuggcuaauuuuguauuuuuaguagagacgggguuuuuccauguuggucaggcuggucgcgaacucccaaccucaggugauccgccugccuuggccucccaaagugcugggauuacaggcgugagccaccgugccuggcuaaggcuuguacuacuuuuaaaauaaaauauaaaaaaauuuuuuuaaguagaaaaacaacaucagucuagugcaaaaaguucaguaaauucacugagaguaaagaugaaauguccaguuaauuccccuaagaacuaguaaacaaaauuacagagaaaaaccuuaaacuuaaaaaaaauuuaaugauaaauacauauugauagaaauuauucaauucuccuaugaaugcagcauccaaggauauucuccauguucauggcucccagcccuucccuccaggcugauggggcaacuugagacccaccaagccagcagacuccuccaccgagcgcucacccuugccaugaaauuccugauguagggccacauguuuccggaugcuacgcaggaggcagagauagguggcagcuuggaaaugaagcucauguugggcucugcacaacuuuucacuggugaccuagagaagcagcaagucagaaauucuuaacccagcuagagauacagguccacagagaaagauuuaauaaauaagcauucacuagagugaaaguaaauugcacagaggaaauacagacauguauguauauacauguauacuuaauacaucuauagaggcacucuauaguuauuaguaaagcugaccucuaguucggauuuuuaaaaggaguugcauugaaugucccuguauucagucaguacugcaagaagucaucuaguuucaauuccuuaauuuuacagaugaggaaacuaaaguccagagaugcucagagguugguuaaugguagauauggaaauuauaauuaggucacucaucauuaaugucaccuaaagaauauuauguagaacuuucucccuuucaagcaaauaaaggacugcuuuauuuauauuucugugacuuugauuaauguggcauauaccuuucauuacaaugaaaauugaaaacuuggccgggcgcgguggcucacaccuguaaucccagcacuuugggaggccgaggcgggcagaucacaaggucaggggaucgagaccauccuggcuaacacggugaaacccugucucugcuaaaaauccaaaaaaaaaaaaaaaaauuagccgggugugguggcgggugccuguaguaccaacuacucaggaggcugaggcgggagaauggcgugaacccaggaggcggagcuugcagugagccaagaucgggccacugcacuccagucuggguaacagaaggagacuccaucucaacaaaaaaaaaaaaaaaaaaaaaagaaagaaaauugaaaacuuuugucugaaaaaugauagcuuugugcuaaauaguaacaaaugaagguuucauguauaaaacuaguaugcuuauguucauauuacuuauuacaauuggcccuccauauccauggguucugcaucuuuggauucaaucaacuugugauaaaaaauacucagaaaaaaauaaaaggauuaucaugucuuaccaaacauauguuuugucauuauucccuaaacaauguaguauaacaacgauuuacauagcauuuacaccgcauaagguauuauaaucuagagaugacaaaguauacaggaggaugugcauagguuauauugcaaauacuacagcauuuuaugucagggacuugagcauccauggauuuugguauuccugagugggggugggggguguccuggaaccaguccccacaguuacugaggaauggcuauucucgcucuuacaauuugcuuauccaucuugaaaacucuggacucaugacuuuaagaagcuagaaauuccauauccauuccaaaguccccaaaugauuccaaaccuuuuuucuucaucauacuuaacuuuugagauucacugcacccucuuuaacuaguucuguauucaaggcugugagaaaggggcaggaaaggugagauggggaugugugcauagcucugagggacuaaaggagccauguccaaauguggauaaaucugggcaccacugccuacauaauacgccccccaccaacucuuuuuuuuuuuuuuuuuuuuggggacagggucucacuuuguugcccaggcuggagugcaauagcgugaacauggcugcugaucuccccagcucaagugauccuccugccucagccccgcaaguagcugggacuacagacgcacaccaccauauccggcuaauuuuuguauuuuuuauacaaacaggguuucaccauguugcccaggcuggucgugaacuccugggcacaagcgauccaccugccgccuccucccagagugcugggauuacaggugugagccaccgcuccuggccuaauccccuuucucuauuugaauaucuaguguuagaaucugaaaacuagaauguguguggcuucuugguuuuugagacagggucucgcuccguggccuaugcuggagagcagugguaugaacauggcucacugcagccuugaucgacuucuugggcucaagugauccucucaccucagcuucccaauuagcuggaacuagaggaugggccaucacgccuggauaauuuucaaauuuuuuggagaggaagucucacuacacuauguugcccaugcuguuagaauguggguuuuaggaucugcagaucauguugaaagcaacauucauuagcugcuuaaaaacagaauuaaucugcuuuaauacaaauuuaacuuuuuaguaauuuaaauuuuaugagaaaucaacaccaaugucaagcauuaacaaaucauagcauccacuucuauuaauauauaagcccaaauuuguggaauuugacaugggaauucuagguuaauguaggauagaauacugcucuugauucgguugagccugaaucaugaggacaaaagggucagcaauagacaggaaacaguaaauagaucacaagaacccaaaagagaucaaaugaaauagaacacuguauuuucccuguggagaaaggguagguuucucccuaauagaaucccuucuccggagggaaaggauagagaaaaugggaugguuauucaguuagcugugagccugaaggaaacagaaaccauuuccccuaugcucaagugcauuccagagugguauuuccagaauguaccaugaauuucagaaccauuaccaagucucucucaaggguaauaauguuauccccauaagguacaacuauaaucaugucaccuccuuaaaaaucuuagaauggggccagguuugauaguucacgccuguaauuacaacacuuugggaggccgaggcaggcggaucaccugaggucaggaguucaagaccagccugaccaacauggagaaaccccgucuccacuaaaaauacaaaauuagccgggcguggugucgcaugucgccugccuguacuacucgggaggcugaggcaggagaaucgcuugaaccugggaggugaucacaaucuuagaauggcuucccauuacacuuacaauaaaguuuaaguuccuguucggccuaccacuucaucuaccuccacuucacccaccacaccuuagggcuaaaccacucucaacuggcaauuuuucuccccuugggcuuucaauuguguagcuuuuaaaccuggacccuaaccccaauuuacuugcuaacuccaaauuagccuucaggucccugauuaauuuccuccggaaaaccuucccuaacuaccccuucuuuauaccccagccccuguugucuacaccuugagcacuuauuuauccucaguacuuuacuguauggcuccuuaggugggcagcaagugucuuaaggacaggacacaugugcaucugauucuuccuguuuagaccagguuccuagcacagacccuaacguugccaccuuuuaaaaacuaggugaauuugaguucuaagauuuuacauucugacguccguggcucagaaauucgacaguugaucguucucccuuuccccacauugcucaagggcagcaaguuuccuucccuaaagcccaguuguucuuuuccgccucaaaaagaaaugcuucuuagaauaacuuuucuaggggacgggugaggaaauuguuggccagaugcuguggcuuuaagucuagcaacaguacacccuucaacuccaucuucauuguuuuauccccagcauugaauccuccauuccacuuuccugacugcccuccgcagaggcaacagaccagccaaugaaauccuucgggacggguccgccccucugcaggacaggcugacguccccagagcgacucugcgcccccccccgcugguccuuugguccccgaguuuaugccagagcauggagccuagggccuggguugguuuggucagaaccagggcuccgugggaggguuggccucagaaaugcaggaauuaaacaccgugcuccccacccuagcccagacccggcucuuccucccuccccagcacguagagcacccgggacauggcucccguacccgaugugcacggaaagccuucacaagguaccgauaggccgcggugucgcgauagggucggccgguggccgcgcucagguagcgcaacucccgcagaaguccucgaaaagugugcgacggggacccuaaggccgccauuguccuguccuucuccgagcguggu

SEQ ID NO: 191601 - RNA, 82098 nt, Homo sapiens
accacgcucggagaaggacaggacaauggcggccuuaggguccccgucgcacacuuuucgaggacuucugcgggaguugcgcuaccugagcgcggccaccggccgacccuaucgcgacaccgcggccuaucgguaccuugugaaggcuuuccgugcacaucggguacgggagccaugucccgggugcucuacgugcuggggagggaggaagagccgggucugggcuaggguggggagcacgguguuuaauuccugcauuucugaggccaacccucccacggagcccugguucugaccaaaccaacccaggcccuaggcuccaugcucuggcauaaacucggggaccaaaggaccagcgggggggggcgcagagucgcucuggggacgucagccuguccugcagaggggcggacccgucccgaaggauuucauuggcuggucuguugccucugcggagggcagucaggaaaguggaauggaggauucaaugcuggggauaaaacaaugaagauggaguugaaggguguacuguugcuagacuuaaagccacagcaucuggccaacaauuuccucacccguccccuagaaaaguuauucuaagaagcauuucuuuuugaggcggaaaagaacaacugggcuuuagggaaggaaacuugcugcccuugagcaauguggggaaagggagaacgaucaacugucgaauuucugagccacggacgucagaauguaaaaucuuagaacucaaauucaccuaguuuuuaaaagguggcaacguuagggucugugcuaggaaccuggucuaaacaggaagaaucagaugcacauguguccuguccuuaagacacuugcugcccaccuaaggagccauacaguaaaguacugaggauaaauaagugcucaagguguagacaacaggggcugggguauaaagaagggguaguuagggaagguuuuccggaggaaauuaaucagggaccugaaggcuaauuuggaguuagcaaguaaauugggguuaggguccagguuuaaaagcuacacaauugaaagcccaaggggagaaaaauugccaguugagagugguuuagcccuaagguguggugggugaaguggagguagaugaagugguaggccgaacaggaacuuaaacuuuauuguaaguguaaugggaagccauucuaagauugugaucaccucccagguucaagcgauucuccugccucagccucccgaguaguacaggcaggcgacaugcgacaccacgcccggcuaauuuuguauuuuuaguggagacgggguuucuccauguuggucaggcuggucuugaacuccugaccucaggugauccgccugccucggccucccaaaguguuguaauuacaggcgugaacuaucaaaccuggccccauucuaagauuuuuaaggaggugacaugauuauaguuguaccuuauggggauaacauuauuacccuugagagagacuugguaaugguucugaaauucaugguacauucuggaaauaccacucuggaaugcacuugagcauaggggaaaugguuucuguuuccuucaggcucacagcuaacugaauaaccaucccauuuucucuauccuuucccuccggagaagggauucuauuagggagaaaccuacccuuucuccacagggaaaauacaguguucuauuucauuugaucucuuuuggguucuugugaucuauuuacuguuuccugucuauugcugacccuuuuguccucaugauucaggcucaaccgaaucaagagcaguauucuauccuacauuaaccuagaauucccaugucaaauuccacaaauuugggcuuauauauuaauagaaguggaugcuaugauuuguuaaugcuugacauugguguugauuucucauaaaauuuaaauuacuaaaaaguuaaauuuguauuaaagcagauuaauucuguuuuuaagcagcuaaugaauguugcuuucaacaugaucugcagauccuaaaacccacauucuaacagcaugggcaacauaguguagugagacuuccucuccaaaaaauuugaaaauuauccaggcgugauggcccauccucuaguuccagcuaauugggaagcugaggugagaggaucacuugagcccaagaagucgaucaaggcugcagugagccauguucauaccacugcucuccagcauaggccacggagcgagacccugucucaaaaaccaagaagccacacacauucuaguuuucagauucuaacacuagauauucaaauagagaaaggggauuaggccaggagcgguggcucacaccuguaaucccagcacucugggaggaggcggcagguggaucgcuugugcccaggaguucacgaccagccugggcaacauggugaaacccuguuuguauaaaaaauacaaaaauuagccggauaugguggugugcgucuguagucccagcuacuugcggggcugaggcaggaggaucacuugagcuggggagaucagcagccauguucacgcuauugcacuccagccugggcaacaaagugagacccuguccccaaaaaaaaaaaaaaaaaaaagaguugguggggggcguauuauguaggcaguggugcccagauuuauccacauuuggacauggcuccuuuagucccucagagcuaugcacacauccccaucucaccuuuccugccccuuucucacagccuugaauacagaacuaguuaaagagggugcagugaaucucaaaaguuaaguaugaugaagaaaaaagguuuggaaucauuuggggacuuuggaauggauauggaauuucuagcuucuuaaagucaugaguccagaguuuucaagauggauaagcaaauuguaagagcgagaauagccauuccucaguaacuguggggacugguuccaggacaccccccacccccacucaggaauaccaaaauccauggaugcucaagucccugacauaaaaugcuguaguauuugcaauauaaccuaugcacauccuccuguauacuuugucaucucuagauuauaauaccuuaugcgguguaaaugcuauguaaaucguuguuauacuacauuguuuagggaauaaugacaaaacauauguuugguaagacaugauaauccuuuuauuuuuuucugaguauuuuuuaucacaaguugauugaauccaaagaugcagaacccauggauauggagggccaauuguaauaaguaauaugaacauaagcauacuaguuuuauacaugaaaccuucauuuguuacuauuuagcacaaagcuaucauuuuucagacaaaaguuuucaauuuucuuucuuuuuuuuuuuuuuuuuuuuuuguugagauggagucuccuucuguuacccagacuggagugcaguggcccgaucuuggcucacugcaagcuccgccuccuggguucacgccauucucccgccucagccuccugaguaguugguacuacaggcacccgccaccacacccggcuaauuuuuuuuuuuuuuuuuggauuuuuagcagagacaggguuucaccguguuagccaggauggucucgauccccugaccuugugaucugcccgccucggccucccaaagugcugggauuacaggugugagccaccgcgcccggccaaguuuucaauuuucauuguaaugaaagguauaugccacauuaaucaaagucacagaaauauaaauaaagcaguccuuuauuugcuugaaagggagaaaguucuacauaauauucuuuaggugacauuaaugaugagugaccuaauuauaauuuccauaucuaccauuaaccaaccucugagcaucucuggacuuuaguuuccucaucuguaaaauuaaggaauugaaacuagaugacuucuugcaguacugacugaauacagggacauucaaugcaacuccuuuuaaaaauccgaacuagaggucagcuuuacuaauaacuauagagugccucuauagauguauuaaguauacauguauauacauacaugucuguauuuccucugugcaauuuacuuucacucuagugaaugcuuauuuauuaaaucuuucucuguggaccuguaucucuagcuggguuaagaauuucugacuugcugcuucucuaggucaccagugaaaaguugugcagagcccaacaugagcuucauuuccaagcugccaccuaucucugccuccugcguagcauccggaaacauguggcccuacaucaggaauuucauggcaagggugagcgcucgguggaggagucugcuggcuuggugggucucaaguugccccaucagccuggagggaagggcugggagccaugaacauggagaauauccuuggaugcugcauucauaggagaauugaauaauuucuaucaauauguauuuaucauuaaauuuuuuuuaaguuuaagguuuuucucuguaauuuuguuuacuaguucuuaggggaauuaacuggacauuucaucuuuacucucagugaauuuacugaacuuuuugcacuagacugauguuguuuuucuacuuaaaaaaauuuuuuuauauuuuauuuuaaaaguaguacaagccuuagccaggcacgguggcucacgccuguaaucccagcacuuugggaggccaaggcaggcggaucaccugagguugggaguucgcgaccagccugaccaacauggaaaaaccccgucucuacuaaaaauacaaaauuagccaggcgugguggcacaugccuguaaucccagcuacucaggaggcugggacaggagaaucgcuugaacccgggagguggagguugcgaugagcugagaucgcgccauggcacucacuccagccugggcaacaagagcaaaacucugucucaaaaaaaaaaaaaaaauuaguauaagccuuuuguuuaaggaauucaaauguuauaaacauaaaauaaaagaaacccucuuuuccuuuguccuuuucccuuguccccauuaccagguggucacuauuacuaacaguuugaugugcaucuuuccagauauuuccuacacauauacaauuauacauacauaucucauuuaaaaauacauaaauuugauguguuacaguccuggcaggaaauagguggcacacucaaauagggacauugaggagaguuaaagggauacauaaagaugugggcgaauuaagguugagauggugaagcucuuagggguucucaauaguagagaggucuuuuuauauuuuauuuuuaacugggcagccccugaaccagaauagguuacgagagacucucuacuagagaguucuaaccucccuaggccugaccaaugcaggcccuuaggcugaggaacauggccacagcucagcuauaacccacagagagggauggaugaguacauagacaucucuuucugucuccuaaucuugucaaauuguuccuucucuugaacucccuaucugggcaaauagcuccaccaugcacuugcuaaccaagacagaaacuugggcuucauuugguauuccucucuccuuauuuuucacaauuauuuagcaauuucagcuucugcaguagcucuaauaaccuucuccucgucugucuccacugccucuguccuaguucaagcacugagaaucuuuuggcugaaccaauaaaauagucuccuaaagggucuauuugcuucuuauauccuuauuuccucaaaaaucguucucuuucugugaauugccaacacuuauuuaccuuuggcuccuuuaugguauaugucaguuucuucugguagguagauaaccucuuuucucggggacuaugucucauucaucuuugcaguuuccaaagcaccuuccacagugacuuacacauugcauguauuaaauguuuuugaauacauaacuuagcuccacuaggagagguacaaccucaacagaacuauucauaaagcaguucaagccgggugugguggcucacaccuguaaucccaggacuuugggaagcugaugugggcggaucaccugagguugggaguuccagaccagccugaccaacauggagaaaccucaucucuacuaaaaauacagaauuagcugggcaugguggcgcaugccuguaaucccagcuacucaggaggcugaggcaggagaaucgcuugaacccaggagacggagguugcagugagccgagauugcaccauugcacuccagccugggcaacaagagugaaacuccgucucaaaaaaaaaaaaggccauucaaaacaccaucucuucuaagagguuaacauuaaaauaauaguauuaauaggucaaacaagcauuuauucgacugaauguauaaaaaaaagaaauguuuaacauaccuuuuuuguuuuguuuugagacaaggucucacucuguugcccaggcuggaauacaguggaguaaugcaaucucugucucccagguucaagugauucuucugcuuuagccuccugaguggcugggacugcaggcauuugccaccacacccggcucauuuuuguauuuuuaguagagaugggguuucaccauguuggccaggcuggucucgaacuccugaccucaagugaucgcccgccugggccucucaaaauguagggauuacaggugugagccaccaugcccagcugacauauguuuauuuguucucuguuuuauuucauggaugcagguuuguuauuaauacugauauuuuacuuugguaagagugaagaaagcaaaagggugaggauagguuaauguuuugauuuccuuuguuguuaccauauugaauauauacaauaauauguacauuauaauauacaauauuauauacaauaauauauaauguuuuuccuuuuuuuuuuaauagagaugggggucucacuguguugcccagguuggucuugaacucgugggcucaagugauccucccaccuaggacucccaaagugcugggauuauaggcaugagccaccaugucuggccauuauuuuucaagaagagauuugaggcagaauugucuaaugguaagaaauauuacaguuuugaagucauauagauuuagauuguuaaaaaauaaauauuuaggccgggcacgguggcucaugccuguaaucccagcacuuugagcggccgaggcagguggaucacaaggucgagagauugagaccauccuggccaacauggugaaaccccgucucuacuaaaaguacaaaaauuagcuggacuuaguggugugugccuguagucccagcuacucuggaggcagagacaggagaaucgcuugaacccgggagguggagguugcagugagccaagaucacacaacugcacucaagccuggugacagagcgagacuccgucucaaaaaaaaaaaauauuuauauuaugauucuacuuguauaauuuaccagauuugugaucuugggcagguuaguugaccugugcuuuuuccuccuuauauuaaaugggaaggccaacaagguuguuguaauaauugagaauaauguuuauauaaaacacuuagggcugggcaugguggcucacgccuguaaucccagcacuuugggaggcugaggcagguagaucacuugaggucaggagauugagaccauccuggccaacauagugaaaccccguuuguacuaaaaaugcaaaaaacuagccagacacacgcaaguaaucccagcuacuuuggaggcugaggcacaagaauuguuugaacccgggaggcggagguugcagugagcugagauggcgccacugcauuccagccugggcaacagagcaagacugugucucggaaacaaaccaacaagcaaacaaaaaaaucagacacuugcauggugcauaaugaguguucaacaaagagaaaaucuuacuguuuguuuuuaucuuuuuacuuuauucucauuccuuuuaucaugaacccuuuucuaagcccuacugccaucagucuucagaaguguaugcguauuauguuauuaagguuuaaauaauuuacucaggccauuucuguucacauauaaccaaccuguaccuccuauucauagucgcaccaucaauaaucagcugaagucgguguuagaaagaauugauucuagaacacaaacuauauuggcaguaaacucuaaauuggaaggucccagccugagaauccugagguuuugguuacuagucuagugauaagugauaaagcacuagugauaagugauuuacuucauuuugcugucucuugcuuaccuccuuuaaugucaacugcuccccccccccccaccggauuuuccuuuaauaguacuuaaauaugcuuaagacuuuuccuucuaaaaacuacucugccucuaucucaaaugcuuuuacagcuacuacccgcuguuccucuucacaaaugaauuaacguauucaaagacuugaaugaauuauauucacuugcuguauuuuugaaacuucuaaaauaaguuguaucaagguaaauuuacauauaauaaauauacucauuuuagguguacaggucaaugaauuuugacaaaugaauacaccugugucauaaauaucccaguaaagcuauguaacauuuccaucaccccaaaagguuaucuugugccccuuugcagucaauucuccuuccccacaccuggucucggcaaccacugaccugcuuguugucacuauagauuuggcuuuuccaguauuuuaucuaaaugcagcuauacaguaugcagucuuuugaggcagcuucuuuuguugagcauacugauuuugagccuuaaccuuaucuuuuuuuuuuugagacggagucucgcucuguggcccaggcuggagugcaguggcgcgaucucugcucacugcaagcuccgccucccggguucacgccauucuccugccucagccuccugaguagcugggacuacaggcgcccgccaccacgcccggcuaauuuuuuguauuuuuaguagagacgggguuucaccguguuagccaggauggucuccaucuccugaccucaugauccacccgccucgaccucccaaagugcuaggauuacaggugugagccacugcacccagccaccuuaucuuguuaguaauccauguuguuguuauguauccauuuucugcauuuuucaccacuuacucauccucaaugcacugcagucugguuuccgccccucuacuaccaccaaaacugcaacccagagguacagaugaccuucaggacaccaaacccaguggaucuuaguuauuuuuuaucucguuuguugucuagggagcauuugacacuaugggcaauucccugcuuuucccuuggcuuugaugacaccacauucuucuuuuuuuuuuuuugagauggagucucgcccaguugccaggcuggagugcaguggugcgaucuuggcucacugcaaccucugccuucuggguucaagugauucuccugccucagccuccugaguagcugggauuaacaggcgcccgccacaacgccuggcuaauuuuguauuuuuaguagagaugggguuucaccauguuggccaggcuggucuccgacuacugaccucgugauuugcccgccuuggccucccaaagugcugagauuacaggugugagccacugcgccuggcccacauucuucuguuuuuuucuuacucuagucauuuuucaguuucauguucuguguaucccuuacauguuggguauuccucaggguccagaccaagguccuuaugucacacccuacaugguuuccccugagugaucaccuccacuuucaugacuucaauuauucucaaaaugcuugauaacuccaguucaggcuccucuggcaugcugaagaccuguauguccaacggccuggaggaugacaccacuuagauaacucaguuaucucaaauucaaugugugcgaaauggaaccuccucaucuuccccuacaaaucucuccugguauucccuaucaguucaaugacacuuucacucagucccugaagccagaaaucuaaguuauucuuuacugcuuucucuccuucauaucuucaguuaaacaaucacuaaaucagauuuuaccuccuaauaagcccuucaauuuuuauugcugcuauccuaguguagaccucuuacaucucuucccuuaaccacugcccucccuaauuggucccuuuuaccuccaauuaugcucucuucaaguccauuuuccccuaugcaacacagaucuguucuugucauucuacucagaacccuucaaagaaagacuuuaacaagaaccuccagggccuggcccuugccagaccucuucagcuucaucucuauucucuguguuugacaguccagcuagaacugaauacagaaauucaguuauugggagccauggucuugauuucaacauuuugcuguuccucauacagggaaagcucuucuuccaaucauacuccccuucaauagcucuuuccuauucauucuucaggauuucagguuaaauuucacuuucuuuucuucaacaaggauguaugaaugccuacuacaugggugauacugccuuagcuacccuuaccuuuucacucuuaaacauguggggagguggcuccuguuuguaaucccagcacagugggaggccuggaugggaggacugcuugaggccagaaguuugagaccagccugagcaacauaaugagacccugucucuaaaaaaaauguaaaaauuagccaggugugguggcaugcccccauagucccagcuacucaggaggccgagguaggaagaucacuugagcccaggaauuagaggcugcagugagcuaugaucauagccacugcucuccagccugggcgacagagaaagaccaucucuaaaaaagaagaaaagccaggcauggugguccacaccuuuaaucccagcacugugggaggcugaggcaggaggauggcuuggggccaggaguuugugaccagccugggcaacauaaggagacaccuucucuacaaaaauaaaaauaaaaaaauuagcugggcaugguggcaccugccuguaauccuagcugcucaggacacugagguagaaggaucccuugagccugggagguugagacugcagcagugagccauguuugcgccacugcauucacccgggugacagagcaagaccccaucucaaagauauaaauuauuuuaaaaaguuucuuucaagcaauauaguuuauaugcuuacugauuuuaauuccccugucuugaauaaaccaauuaacuaguucuuuugguuuagguuuggcucuugucauuucuccucuccacaaacuucagauauuaauacauuuucacuagaacugaggauguuucuggcuauaaaguauugaguuccuugucugguuaaguguuagagauacaaauaugaacaugugauaagaacaagauguucacauacuaggauuauguggugggaaaagaaaucuguguugcucugaacuaaaggcaggcuaauccaaggcagucuguaaaguaaguuuuaauuuauccaacuaaaagauaguaauuuucaaaaaauuugaauuuuaaaaucuacauuaauaggcaccggccgggcacgguggcucaugcuugcaaucccagcacuuugggaggcugaggcaggcagaucaccugaggucaggaguucgagaccagccuggccagcauggugaaacucugucuuuacuaaaaauacaaaaauuagcugggcuuggugccagguaccuguaaucccaccuacuugggaggcugaggcagagaaucgcuuaaaccugggaggcagagguugcagugagccaagaucccgccacuguacuucagccugggugacagagcaagacugucccaaaaauuaauaggcaccauguuuauaaaauuugauuguauguaccgaugccccaaguaaaaccgcaauauuaauuuguaugauauagccuuuauuuaccauauuuaguucauaaauuacaauaaauugaaggguugucuguucuggacagcuagcaaaacauguuacuuguaccuauucuguuuuaauuaccuaguuuuaaauguauaguuuaauccuacuuuauauuauuuuguuacccucugagaccuuguuccuggaagaggaaugguuaucauugcuaaaauguagacauagacauacagagauuuuuuuuuucagaugcuaagaugaauacaugguuacuacacuuaaaauuuuugcuuugggaggccaaggcggguggaucacgcagucggaggccauccuggccaacauggugaaaccccaucucuacuaaaaauacaaaaauuagccgggcgugguggcaggcuccuguagucccagcuacucagaaggccgaggcaggagaaucacuugaauccgggagguggagguugcagugagccuagauugcgccacugcacuccagccuggugacagagcaagacuccaucucaaaaaaacccaaaaaaaacaaagaaacaaaaaaaaauugaaggccaggcacgguggcucacgccuguaaucccagcacuuugagaggucgaggcaggcggauugccugagcuugggaguucaaaaccagccugggcaacauggcgaaaccccgucucuacuaaaaauacaaaaaauuagcugggcuugguggcuggcacuuguaaucccagcuacucaggaggcugaggcaggagaauuacuugaaccuggcaggcagggguugcagugagccgagaucacgccacugcacuccagccugggcaauagagacucggucucagaaaaaaaaaaauugaaaaaauuuacaaacaggagaacaaacuuccaauucuguuaauggcagucuagguaauuuggagugacccuucuguugaagacaauuggaacaaaagucaaaauuuuuuuaaauucuugaaaucauuaaagagcuaauaaaacuaguggugaaaugcugggucagaacauaggagaagacaaccaagacaaguagcguagcacacaaagacacauugcuggcaugauggcauuugucaauuuauuuauuuuugaagcagagucucucucugucacccaggcuggagugcaguggcacgaucuuggcucauugcaaccuccgccuuccggguucaagcgauuccccugccucagccuccggaguagcugggauuacaggcacgugccaccacaacuggcuaauuuuuuuauuuuuaguagagaugggguuuugccauguuggccaggcuggucucgaacuccucaccucaaguuauccacuggccuuggccucccaaagugcugggauuauaggcaugagccacuauacccugccagcauuugucaauuugguagaaauagcuucaguauugaaacugagcugcacuuugagugagcuauaggacugagagaaaaaaaguuuuggcucacaaagguagggacucuaauaaaucacacccacuuuaagcuaggacccugaaauucaaucccaaaagugaauuggaaguaaauaaaacaaaaauucuugcuggacuuuuuuuuuuuuuuugagacagggucuugcucuguuguccagguuggagugcaguaguaaggucauggcugauugcagucuugaccacauggggcucaagagagccucuugccucaggcuucugaguagcugggauuacuggcgcacaacaugcucugcuaauuuuuauuuuuguacuuuuuguagagacaggguuucuccauguugcccaggcuggucucaaacuccuggccucaagugauucuccugcguagaucucccaaaguguggggauuacaggugugagccauggugcccacccagccuccuugccagacuuuccgcccagauuuuuguuguuuguuggucaagagaaaaugaggccuugaaccuguauuauggugguuccugacuaguaaucucuucaguuaccuaaaaaggaaaauaaaaauccucucuggaggaagacaggauuauauccuauacuuagggcuuauauuauuucuauacauuuuuuuuuuuuuacaaauacauguuuagcacacaaagaaaaccaggcacacaagaaaagacuucauaugugagaaccaacaugagcaacagaccacaaaaaaccuuaagauacuauaauuggccaacucagauuacacaacaauuguucacuaaggucaaagaagcagccaagcuuggaaauuucaucagggaaccaggaacuauaaaaugacauuauagguuugauaaagaaccuaauacaaauucuacaacugaaaauucaacugauggauuuaacaacaaauuagauacagcuccauagugacauuaaugaacuauaaaauuugucagaaaaaggcaucggcuuugaaagaccaagguaaaaagugcaagacugagaguaaagagauaggauacagugaaaacuaucuaauaugcauguauuuaaauguccagaaguugaugagaggggcaauaucugaggagguaagagcuaagaauuuccuaaauugacaaaagauguuaguuaauggauucucaaugaacgaaugaaugaaaacucauuguucaaugaguccauaauggcaugauaaaguagccagcuaucuuuaaaagagugaaaaacagaacugacuucuuaggagcaguggaagguaaaagguuagguagaauguaugugcccaaagaaaauaaccacugggcgugguggcucacaccuguaauuccagcacuucaggaggcugaggugggcagauugcuugagcccaggaguuugagaccagccugggcaacauagggagaccuugucucuacaagaaaaauuuuaaaaauuagcucagugugguggugcauaccugcagucccagcuacuugagaggcugaggugggaggaucacuugagcccgggaagccaaggcugcagugagccaaggcgagaucucgccacugcacuccagccugggugacagagcaagacccuaucucaaaaaaaaaaaaaaaaaaaaaaaaaaaaaggaaccuccaaccuaggauuuagcuaauaaaaauauccauuuagaauuuaaagcaaaauaaagaucuuuuuagauaaacaaaaugggagcguucccccaacuagccgaccaacacaaaaacaaacccugaagcaagguaggcaaacuucauagucaggcugggcacaguggcucacccugguaaucucagcacuuugggaggccgaggcagguggaucacuuaaggucaggaguuugagaccagccuggccaacauggugaaaaccugcguuaaaaaaaaaaaaaaagucagauaguaaauauuugaguguuguaggccacacaguaugggaucccucacaaaccacccaacucuauuguggggcaaaagcaaccacaacaauauguaaaugaacgagccuggcaguauucgaauuuuugugaaacuuuauucacaaaaauaggccgugggcugcauuuggccuguggaccguagcuugcugacuccugugcuaaaggauaaacuucagacaaaaaggaaaugaucccagauggacaggcagagauuuccgaaggaaugaagagcaaaauaagugguaaauaaagaacauugauuauauaaaacuugguuuuaaaaaauaagagaacuaaaagaccugguaacaagagcauauaacuugggaugagaguaaauggaguuaguguucuagguuccuuguauuaccucucuugggggaggggaguauaaagguauugauuaaauuagacuuugauaccuuaaggauacacauuauaacuucuaggguaaucacugaaagaauaaaaauauaauaaaaugaaacuuccacacuacuagaguggaagaaauuggaaugauuaaaaaucaggcaggaaaggagagaaaaacaugaaauagaugagacaaauaggcaaaaauaagaguuuuaaacccaaacacaggaguaauuacaugaauauaaaucaucaaugcuuccaagagugaacaucacuuaauucacuccucaauuucacuccucaauuuugaucauuauguauuguauagacuauuuuuaagccccaauuauaugcuguuuauaagacaucuaaaauaaaaaaaagaacucaaaucucuucaacaaaacauaauuauugguuuuaguguauuucuuuaaauacacuguuuuucagggucagaucacauuguguacauaauaguguaucccucaaagacauauuaauuugcacauuuuucuauuauuauaaaucaguucccaaaggauauccuaguauuuggaguuuggaauucagaguucucugaauaacugaagagaagcuauuuuguguauuacuaaagauaacuugauucaaaauaauuuuuuuuuuuuuuuugagauggagucucacacucaccagggcuggagugcaauggcgcgaucucggcucacugcaaccuccgccucuuggguucaagcgguucuccugccucagccuccgguguagcugggacuacaggcaugcgccaccacgcccagcucauuuuuucuauuuuuaguagagacaggguuucaccauguuggcaggcuggucucaaacucccgaccucgugauucgcccgccucggccucccaaagugcugggauuccaggugugagccacugcguccgaccucaaaaauuuucauuggcccaauacgcauuuauuuuugagauagagucuugcuuuguacccagccuggagugcaguggcauaaucucggcuuacugcaaccuccacuucccggguucaagugauucuccugccucagccuccgaguagcugggauuacaggcacgcgcauccaugcccggcuaauuuuuguauuuuuaguagagauggaauuucaccauguuggucaggcuggucucgaacuccugaccucaaggugauccgcccgccucugccucccaaaguacugggauuacaggcaugagccaucccucccagccgcaauauacauuuaaaggaauuuugggacuauuacuacuauucauguuuuuuauugaucugcuaauaacaguuccaaggcgaugaguauacaguguuaauggaacacaaaucucuauuauuuccuuucaaaguauccaggaagugccugucuucuuaaacauuugauuuuauuaacucauucuucuuacaguuuuaaauuucuuuuuaggcgaugaauauacaguguuaauggaacacaaaucucuauuauguccuuucaaaguaucuagaaagugccugucuucuuaaacauuugguuuuauuaacucauucauuuuucuuacaguuuuagauuucuuuuuaagcaaccuuucuuccugcacacugaccuaugucuuacuuaaggaauuuuuuuuuuuagaagucucgcucugucgcgcagguugcagcgcaguggcgucaucucgacucacugcaaccuccgucucccggguucaaacgauucuccugccucagccucccgaguagcuggggaggcgcccgccaucacgcccggcuaauuuuuauauuuuuaguagagacaggguuucaccauguuggccaggcugaucuugaacuccugaccucaggcaauccaccucccuuggccucccaaagugcgggguuuacaggcgugagccaccgcgcccggcaaggaauuaauauuuuacuaaaacaguuuuuagaaacaccagggaaaggcucagggcuaaguauuuuauuccaguuuguucuaacagccacgccauagcagacgugugaccaccuccaccagcccuacgagggguagaacugaagccaaggccccagucacgggccgggcuucagaauccaggcuucccugcggccagcgccgcuggcucccugcuccccgagaucgccuccccaguagcugagaauacgcugaguuuuuaugguuucacauucagacuaagccgcccgcgaccuuguagguaaagaugaauccgaaugggucggcgcgccuguuuccuaggguacugcuuucgggcgcuuucuccugaaguugacacuucccagccgaggagccuuaaagccccacgcagcggaaggaacgcggccccggcggcggcgagacaggccugcucccggccgggaaaggcgcacgagaaccaggacgcguccacgccacucggggcgggcguucgccccgagcacgcccaccucagacgccaaggaggcugaccgcaguccggucgacgaugggcauggucucuacuuacuuuccgcccaggcuaaccucuagcgcauuuugcuaauuugggucugaaucgccaucaccgcgggcagcgcagccuuagccgccagcccuacagccgggagggaauguaauguaagguuuggcgccucggggcggauccggcuugcacagucaguuaaggaaccagaguaucgcgagauccgggguaaaggggcgggaggagcgcgcgugcacgcgcccagagccguuaggguggaacuccacucgggcggggcgggcggagugauacagcuggacgccaguugguggagcccccgcgggaaacgacugagcgcgaggagcgugcgcgcucccgucguggcgacgguggcggcgagcggcgucagagcuugaggggggguugacggcuucuggcggguggcgguguugaaggcgagagcuugcuuggcccgugucgcuucugucccaagaaccggacggagagugagggcacgagggucgcugucgggggcugucgucuuccacguacacgucgucgugaggagcgcaguccggacucuucccgcaaccccuccggcucccuuuccgcacgccucgaggcggcggcggccaccgagacagcagcgcaccuucccccaucccuuccccuuaucccccagcccaaaagggcccggucugcgccccacccccgcccguccgcccgcuacgccgccgccaugucggcgcaggcccagaugcgcgcgaugcuggaccaguugaugggcaccucccgggacgguaagucucugccagggcccugggggugggggaggggacggggacggcgaagggaagggguuccgagggcgcaccugggcgcgcgcguguggcugaguaaggggcucccagauugguaacacgagguccccgucccccgucccauccaaucagggcucggcaggcgggcagggggggcggugaccaugcggauuggcgggaacugcugccaauggggugaggcggggccuggaggcagaaaggagaguuugugcuuuuaauguugacuuggcugagacgggagagcccgcgucucuguugcguaguuggggggcccguuuugucgcugguuagguaccugcggaaagcuaaggccuccacccccgauauaauuccuuaacccagagcuuugggaucaucccucgccgccguccuccagaguaccuagagagaagcuucccccuccucuuccugggucaggaggaaaccuuuauuacuaacccagucucagagaugcacccucgagccccacagaaacaaccauuuuuauggaaaaucugacccaaaccaugguuucuuaaguggguguguuuggccccauuuugugagaaggaacauguuauggccuguuuuuccgagagaccuccauuuuguuagacaauuuaauagaggcuuuguucaguaaauauugacaaauguugcaugucccuaacagaacgauuuugaaaauuugguacccagugaaguagaauagaggagaacaaagauccuuucaggcguuuaguuuagaaucuguauagagagcccuuaauugcuggauuauccuuugucauaaagagaauuucuaaauaaaaugaugaaaugcuguugcuuuuuuggugauguuaauuaguaauguacucucaaauucaacuuaaauacauucaaauauguaggaaaggucuaguucauuacuuucuuaacacagcaaaauccuugguaguuuuuauguguugcuucuuuaggcagauaguuucuuagccacuaaggaaaugcuuuuuuucuugagaaguuauuuaaguguauugauuuaagagaaaaggcacgucuuaaauuuaguuuuuaaguuacucuuuuaauuuacaugagugcuuuacagcaaaauaugaguaaauuuuaaaaauuuuauugcauucaaaucuuucagcagugcguagaguggcuuuucaguguucacauuuucaguuuuaauaaaaacccauauugggaacuuuuauuuguagaauauauagacaaauagguguagauggcaaaccuacuugugguuguguagagaggaaagauugggaaggaaaugaguuuuguauggaaaguuaacauuaacuuaaaaugccacuggagaaacuuuuaacuguuaucauuucucacguuuagauaagaaugguuacuuuaucacugcagcaugucuuaacauuccuccuuuuccaacaugagagaggguauugggaacggguuucauuggauccuagcuaacagaauaacuaaucuguguaauaaaauuaaguuauuuaagacgugcuuuacaugauccuuuuaauccuugauggauaccauuuuugggaucuucuucauggauuggauuucuuaguuuuacugggaggguaguuggaucaagguaaaccaucuccugauaaguuucugaauuaggcagcccgucuaguauugcaaagcuaaauuuaaauauauauauuucuguguguguagucagcagaaacauggauuucuuaaaauccacuuuguguauuuuuuuaugugucuguuacuggauuuuuuuuuuuaaccuucagacuuagaggauuuaugaucgaacucauauuuacgaguccacaguauuguuuagcugaaaugacuggauuuucacugcuguauuggguuagaaguaaaaaauauacuacuuucaaggaaaaauaauugaguggaguuuuuuuuagauaucaaaauuaauucuauauaugcaaaauaaucagaacauucuuuuuuuucuuaccauuuaaugaguuuauauauaucauuuuaugauucaggacuuuuaauaauuaggauuguucuuuuuuagcauacagucaacuucaaguuacccagggauaggggaacauggaaacguccccugaauaacaccauguaauuugaaaccauuuaaugggaacccuuguauuggacacacaaacagccuaugggaacgcuguugggugucuuuggcacuaagagguggaaauggguauccaggaggugggagagagauggaaaagguagguaggaggguauuuaaggcaacucuguccuuuuuuuuuuuuuuuuuuaauuccagagacuauaaagcagcgacucucuuuuuuggaagugggguucaagguggcagugacccccuccacucuuaguguccugucugugaaggaaucugaaguggcacagaguccuggggcuuugggaaaacauuaccuccucacccccucaagguuucuucccccuccccuuccugacaguuuuuaauuaguuccuuuuaaaauucauuggagauuuaagucuguuaguuaaauauaccuuaacuugaauuacauaaaguaguuaaucauuuagauuaccuaaacuucacuggaauccuuaggaguaggaauuuuguuagcagggaaauggagagguaauuuuggaucacugggcacuucaagaaaggacauuccugggugagugguggaaguugggggcuuuagacaaucugagggcagcaugauggugccgggaggcugggcagggggacugccaggaggugggagagaaaugcauaagggaggugggagggccaaagacaaacucugccuucuuugcaauuuugccuagggcccuggugguggcaaccgccugugugccacugaaaaucgugccgaugccuggcauacugcauaaauggaagcaggguaccgcgugaguugaaacauuggucacacuauauaaaguuuguauaugugaaucaguguaacucauacccauauaacugggggucugacuguauuuggauuuuucugauaaggcaucaugggcuaaggaaaagagcacugggcugagacucaggagaccugguuucuagccccagcuguaccucuaauuguaaccuuggguaagucacuuaaccuuuuuugccucaaguuaaaucuguaauuuguuauaugggaaaccaaauaauuuccuauguuauacucagaaauguugaaaaauaaauauauuuuaaguuuuuuuagaaaggagcuauaaguagauaguaauuacuaguuuauuuuaucuuguuuaugauucauuacguuuuauaaauaucuuucuguuuuaguuguuagcagaggggagagggauaauuuguuuucccugaacauauucauucuauuugaaagcagggaggaguugcacaggaaaauccaagaaacaguuugagaauugucugugugacaguuggaagaacccaguacccucacacagacugugauuuuugcucaguuggauuaauugcaaggauguuccuuagcuaaagccccuuugccaacaaacacaguuuggucauaagucucuagucuugaucccaggaaagucugggaagaugcaagcaauaagaauuaaauaaaauugaggguguggauuuagauuacauccuuuuuuuuuuuuuuuuuuuuuuuuuuugagacagggucucuguugcccaggcuggagugcaguggcacgaucucggcucacugcuacaaccuccaccuccuggguucgagugauucuccugccucagccucccgaguagcugggauuacagguggcugccacuacgucuggcuaauuuuuguauuuuuaguagagaugggguuucuccauguuggccaggauggucucgaacuccugaccucgggugauccaccaugcccagccuagauuacauuuuaagcuuagaaauuagguaaguuauagaagguaguucugaggguucuguaucucuuaauugcuuauaccuuuaaaugggagcagagaccaccuucgaaagauuaaaauaggcaggaauggcagccugcccuccaaaacaacaaguagacuaggaauguuagauagaauuuuauagcaucauuaauugucccuuaugguuagggacuguuucgggcaaguuaaaacuuucaauaauuuuaacuauuuuaaauguuaaucuuucuaaauuguaggauauacuuccucaguuaacauauuaaucauaauauuuuugcugaucaguuguacaguaguuauaguuugugggauauaaaacugaaaggauacucauccucauacccaggaaaauacuguuaagaaagccauuuacuuguugcuaauguaagguuaguaguacauaaccguguaaucuguaagauaguaugacauuucugccuuucugcaaaauuacugaaucaaaguuugaaguagugcguucuuuaauggauuuuauuuauaaaaucaucuuuacuguaaucuguguuccuugacuuuucaucaacauugaaaacauuuucucuuaauuuuuucucauuaacauaaugaaccauauucauuucuuggucaguugugagccauucuuuuauuccacuuggauuguucauuuuaagugaaggaggcggagccuuuaauguauacgcagacauuuuuuaaauaauaacaggauauuucuuagucuagagcuuguaaauucuuuaauauaaggaguuuuauaggauuaaacaguaguuucucugcguuucaguuaacuauuuaacuuuaucagaguuucaggcauauccaaaacacugaaagcaccugcauagugaaucaaugaaaaaagaaaaguuuuccucauuuugcauuuugaacucugaauaauauuucuaucuacacagcagcccagaaaacaauaaaaguaucacuucauauaacauugcaucguuccuggauucucuacaguuguuuaguucuccucaaguaagcauaugcuucugagacauucuuuuacuucagguaaauauaagcaaaacaaagaaaaaucauuuugucuauuucugcaucaguucuauaaggagcaaguaaauucuuuuauuuucguuuagguuggauguugucauauaaggauagaugguaguguucaacguguucaagauggguaguaggaauucaauggccaugaggugucauggaucaaggucagguuuagugaaucagguacucuucaguaacaggugguucauacaaagcauugaagcuuaaaguugcugugaguucagcaagcaggaggguugagaagacaggcagaugguuuaaaacuaaaggucaauaagugggcaagacuaguuaaaugaggcagauacuccccaaagauggaauuccagaaaggugcuugaaaaggacugaauucuuaaagccuacugcuguuaguauguagaguucuugaggaaacaagcaguuuggcauaacuuaaucuacuaagaaacuauaagaaggugaaggaaguuggaacaucuuacuggaaaaagaaugagggagugaagagggaaucuugugaauucaaaacuugcagaaaagcuauucuguuuccuuuuuguuuagguucucaugcacuagcagcugcuagaauagauauuggaaggcagggccaaaauaggucaguuguucaguuuugcaagauuauugaggauauagagaaauuaauuugugaaaacucugaaaucaucugcagcuccauguuuuuguuugaacugaauaacuuaggacuuugagaagucaaagccgucagaaaguaacaugaaguccauucagcugaauaaaugucauauuuugcuauuagcauagaaaagaaucuuuaaaacuucuuuccaaaaagcacucaguauugacccauauguuccaguauaguugugaaccauguacaacugauguuugacuuauuugacucaacaugaaaggaauuuaaccagcugcccuugcugaaucuugucuccugaauaugguaaaugguuuuuguuuuuaaucuuaauaccuuagauuucugcagaccccaguuuucucuuuuagaguuaacugauaauuauuggauaguaucuauaauauaccuggcuguucuguucuguacugugcucuaguauuaguuuaaaugguagacuuuucucuuaaaguaacuuuaauaguuuaauaguuaaaguuacuugaagguauguuuuagaucagggacuggcacuauggccuccugcuuuugguaaauaaaguuuuauuggaacacauccaugccgauucauauacaugaugucuauggcugcuuuggcuuacgacagcagagcugaaugguugcaacagagucauauggcccgcaaaccgaaaacauuuaccauuugacucuaacaaaagcuuguugaucaccauucugguuuaguuauucuaaaccaagugugguccuuggagcagcaauucagcaucaccucagcaucacgucguauuguuagaaauauaaauucuuggacccaccuacugagucagaaauucuggauaugggccccagcaauccauguuuuuagaaaccuuccaggugauucugauacacauuaaaaguuugagaaacccucuucuagaucaguguuucccaaauguuugucacacuuauugccuuuauuauuauuuauuuuuauuuuuuauuuuuuggagacagagucucugucucccaggcgugaaaugcaguggccugaucuuggcucacugcaaccuccgccucucgaguucaggcgauuacccuagcuucccgaguggcugagaugacaggcaugcacugucaugcccugcuaauuuuuguauuuuuaguagagaugagguuuugccauguuggccaggcuggucucaaacuccugaccucaagugaucuaccugccuuggccucccaaagugcugguauuacaggcgugaaccaccaugccuggccuugccuuuauuauuauuuacuguuuucuguuuauuuaauauuuuccuuuaugucaacucacuuucuaaaaauuuuaaguuaauuuuaaaaugaaaguuuauaccaccauaaaaauaaauacaaugaaaacaaaaugguguauuauguaacuagacucuugucacuuaggguuccugugcuaaaaauuagaaguuguuaaauuuauuaaacaaguacuguugcaaaaugggaacuuuuuuucuugacuuaauugugauuaauaauuuccuuacugagugguauuuaaaaugucuuguuggcaaaaucauguaacaccuaaagucaucuuuugugcaaaucucauacuuuggaaauuacuguuccagggaguauucaugugaaaggaaagcuguuugaacuauauauauaccuaagccuguaagcagaaaugacuggacagaaauacaagccugugagacagagagaucuaggagaucccuagagagguccaucaagaccuccaggaugaaauuaccucauuuagcucaauuucucaccucuccguuagugcuuugguccacgggggucaguguuucugcaggauuucaccaacugguuccacagugggaaugugaagagguaccuggcugugggaaaagcugcuuaucaaagagaggccugauagaaaugcuagggaaaguggcugugagccugcauuauggacgggagcagagcggcagggcauguugcuaggacuaagcagucgauucacgugagucuggacaccauguauaaauauuuugaaaacuuccuguuacaauuuaauuuacuccauuguguuagagggagugcuucccugcacaugguguucuguauauuuauugguugaugugcuuuaggguauaguaauuauuuauagcaauagauugauacccagguugcagaguugcuuuaguuauaucuuuauuuccuuuucuuagagauuauagacauaauuugcuucugucaucuuuugaccaaaaaucuaaugggaaugaagaauuacacuugaauguuuauuuuuaaguaauaaguucugugauagugauuauaggugucugcauuuaaaaaaauguuuuaaaaaguacagaggucaaacaagcaucuguaugauugaacaaauguuauuucguauauuucugucaaauuuuaaaaaauggauaaagaggccgggcacuguggcucacgccuguaaucccagcacuuugggaggccaagguggguggaucaccugaggucaggaguucaagaccagccuggccaacauggugaaaccugucucuacuaaaaauauaaaaauuagccagaugugguggugggugccuguaaucccagccacccgggaggcugagguuggagaauuguuugaacccaggagacggagguugcugugagcccacauggugccaaugcacuccagccugggcgacagagugagacaccgucucaaaaaaaaaaaaaaaguaaaaagugcauaaagcauuacaaauaaagucuuuugugguccccuucaccgucucaguccuuuccccagaggcaacccuuuuuguaaauuuguugcauauucacugugaggcaguauuucugcuguguuguuuaguuuuaaggcucacgucuccuucauggugaucuguuuuucauuuuaacuucuuccuuuaucauuggguugucuaucaccucugucccuugauauuuucaucuuuuuuuuucuuuuuuauuucuuuuccuuuggauuuggggaggcucuaguuggcuucuguagcuaucaccagcugaugagaacuugucuuuuuuaauagauaaaucagccaguuacuuuuucuuugauuauuuucagcuauugcuugauagccaaagauagcuuucguuacuucuaauuuuguauauagaaaguucuggaugauagaaggcaccggcuauccagagugcaauuguuacuaugucagaauuacagcucugcaaguaaguaucaaaauauaaaauuuagcaggcuguaacuuuuuaugccauauaucuuaaaauaaauucuauauaaccuauuuuaggacuuaauguuaaaguaacuauucaggcuuuucugaugucucuuguaaauuuaagaagaggaauaggcugauagauuuccuaaagcacauaccccccaaaacaugauagcauuggucccugccagcuaccaagacccuuugcuuguauuaauauaaugagagaagauaggugcagggcauggaauagagccuuggaauggagauucuuuaguauuccuguucucacauuuucaucaucaccauucugguuagcuucaaaagauccuacaagguuuuucuucuacuaacaaggcuguuccccaguuucauucuuauaaucuugugauauggauuuucacagacaagugggccagauuuuuaacauuuuaaaaacauuaaucuuugaucauauccagcaagaaugaacuuguucuggagauuucuucuacagugggcaucacauuuuaaaaauguuuggcuugucauggggauuaugguggggggugauacugguaccuauuucugauuauaaacuuaugggaccauaugaaccagaagauuaagaaggauagcuuuucugagcuguauagcacccuuguguuuacauuuucuggaggaaaggaaagcugcuuuguuuuauuaggaacgacuugaugucacauuuggaaggcagacugucauaauuguuuuuucccguugccaucuuuggcauaguacucuuucuucccuuuccuuauguaauaaauauaugccuggaaaguuuuacauagaucaagacauauuaaauguuuucaaagcaucuguauuauuauguuaagacauggugaugaguccuuuuguaaaaugaacccuauacuuuggaugguuuaaauauacaguggguuaaacugaguguauauauuaacaggggaacauguagcaagggaguaauguuuuuuuaaaagguuaauuacaaaaggauuuguauagguggauuuuaagcugaauucuaaaggaacaacaaagguaggugggagaaguugguagagugggugagaaaguuugaggaagauguaaaaaugaucagauuggcuccuuaguauaagaguuacugugcagcaguaaucaucgcuuuuacuuugauuccacaugaagacacaaggguuuuuuguuuguuugguuugagacagagucuugcucugugagccaggcuggagugcaguggugcuaucucagcucacugcaaccuccaacucccagguucaagcgauucucccaccccagccucuguagcugauauuacagaccugugccacuacacccagcuaauuuuuauauuuuuaguagugaugggguuucaccauguuagccaggcuggccuugaacuccugaccgcaggugaucugccugccuugcccacccaaagugcugggauuacaggcaugagccacugugcccagugacacaagguuuuacuugugcacugcuuuagaucucuuccugcccuggacuagacuagaaauuggccauggaucuuuauacaguucccacauuauuacgugaacucagcagcuuauguuggaagaaauggagggaaaaagagggaggaacguuucucugcauuuagggauucaaggggucaggaaaacaagcuuuaagcuuuugguuguacaccucucuagcucuagcuuuccuuucacugagggguuauggaucuuauuucagagggaaggaaacuguccugucccaagcccacugugacacgugacccuuaacuaguauaccuguggggagggcuucaguugccacccuagagaaugugggagggcuucccuuccccugcccccauuuguagacaugggagugucuccauugcuuuguaugcuguugcauucuccucccuccuuguuuucccuaagcuaagcucuaagcuaauucuguacaaaauacugauuguuuuuguaaauugcuugccaugaaugccugauaauguacagugaaauaggauucugcauaccauuaaauaugucaaauauuacaaacuuuaagguucuuuugaaauuacaauacuaaacucaguucacuuuugcuuagccuucacaguuguugaucacauagcauggucauccacucacagcuuaaaaaaauacagggagcaucggagagaauggguaaaguaaaauuuugauguuuuuaaaauagcaccuaaaucuaugaaaguugauuugguuucuuguuuguaugggagggagaggguggguaguacuggggggagggggcggauauugggaagauagcaugcaaaguauaaaaucaugucagauacuaccuaggcuaagguuguaauguuacuaauaaaauuuaaguguuaauauaaguuucagaaaaggcaggaccauagaauggcaguguugggaaugacagugggcuuauuuuuucccuccugauauauggaaggggauuuugagaauagcaguauuugaguaaaauuuagagaggaggccucuuuuuaaagugaccugucuauauucccugguggaacugacugccuuaggcucugauacauuggugacagaccuggagaugaauaauaugcauccucauuuuuauuguauacuugugacucagguguucucaaagguuauaauucaugaaacucaugaagguguugaacaaaagagggaggaaagagaguuguugcuugguagagaauuugguagaaauaggaauuaauagaaaaguugauguuucuauuaaaaugaaaaacaccucacuugcuagaguucuaaaucaaguuucuaauucuaaaaacuuggcuguguaguuaaguacaaggccugaauaacuauuguagagguuauaggacagagagaucuccauguuuuuauaggugggauauuuuuuguuguugacagaaguaacuucgccugaucucuguuccauuauuuuaauuuuuuuuuuuuacuuuauacacuaaaaauuuggauuaaaaaaugaaaaauguaagaaaucaaauguuacucaaaaaguauuguuuugcucccaacucugcaauucuacaugaagccauuugccaaagccagauaugguuuacuuacuguucccccaaaccuucuugcucuuauaagcuuugucaaagcuauuacuccagguuguagugcuuuuuuuucuacuuuacuuugaucuaaguccugucuuuccuucaaauuuuggcuacuuauugcaugaagcuuuuuccaauauuuccauucuuggugguaauuuuagucuaagaauuccugaaguacuaccuaauugaaacacacauuugauacuuggaucauguuaucuuguauuauaacuuauuacuccauuaauauauccucggccgggugcaguggcuccugccuauaaucccagcauguugggaggccgaggugggagggucauuugaggccaggaguuggagaucagccuuggcaacauagugagacccugucucuacaaaaaaauuuaaaaaauuaaaaaaauuaauauguccuauuucuuuagcaaaaucauuggcuccuugaggggagagagcuugucuuauaugccccuuuguaauuccauugccuagcacagcagauguugucacuaauagguuugauucugugauuuggauccaaugucauugugacaggauacuuuuucccccauaauagguuauuuuuauaugacuuuaugcccacaaaacccaaagauaaaacacauuaaauugaaaauaauuucuuguauuauaaggugauuugguuccuauuugcaguucuuucuucuuuuuauaaaauaggugcuguuuuaccuaguuucuuaugaaaaacaugguuugggccagauaucuugacagaaaccaaauuaccagcauuuuucuuuuaaaaauuauuguugguuuagcugaauuguacugccauggaauaagcccaaauaaauuuguuaaguacugcaugguuaugcagccagauuguuuuaaaauguaaaccuuaaaguccccaaggcagaacuuuaaaaauaucaauaaacagucaguugcuauucucucucaagguauuucuguaucucaaauuauuaagcguuuuauuauuucauuguuuuaaagauuucuauaauggcugcuauuugauagcuguauuuguugaguuugcuacgguuaucaaauauuuauggagcacccauucauuugcggugaggaguuauuuuaaaauguuuuuuggcauuuauagaaacagauucugaucuuaaaagcucaccagggaaaauauguacaacuauuauguauccauaaaaauuuuaaaaaacacaaaaaagcucaccagggauacugccugguuugcuauauuccuauuaggaauuuguucauauuuuaacugauagcugugucuucagggcacaauaacuuaauauuugaauauaaguuguuaagcacaaaucaguuacucugccugaugaaauguuugauuaguaaaacuccaugaauacugauuuuauucuaaggccugagccauuaguuuaacaaagcacugaaaugauucugcuguugccauuaccaaaacauuuagauacuuuuagcaggaagacuuauuagauacauaagggauuuuuuuguuuuguuuuguuuuuguuucaacuuuaaaauuuuaucauuuuaaaauugcuuaauauaauuaggguacagauuuaaaaugaaauuuuuuucuuaaaugguaggaagcaaaaagcuucuaauuaaauagcauugacauucugauaugaguuuaucauagcaccauucuaacaugagcuugagguccucaccaaagucuugaugaaacauacuuuuuaaagaaauaauuuuuuaaaaccccacuuggcucaaagacauuguccagagcuccagcuuuggacuuuuaccuguagucagucauacaauuaucugggguuauacuuguuaagucaguauuuaaaaaaaugaaacacccugauuuuguucacuuuuguuuuuauauaaaagaaucuuuacagucaacauguacuucuagaugcuguauugaaauugcuggcagaguuuauucuauacaaaaugaacaaucuggccccuuguuuuauuuguaaagguucaauguaucuaugccugccuaccucaaucugcaagggagugucagaaaggccccgcauucgccaagccgugaguuaucgcuaacuuuucagauguguuaaugaauguggaacaaaagcaguuguguuuaaaaggaaaaaggaccaucaaaauaacuuuuauuauaguagcaggcguaaacacuaaacugaauauuccaaauugugucaaaaauaaccuacuagagacgagcuucuagaaaaccuauuguugaacugcucugaagcuaucauuuuaacuauaaauuacuguuguuaaaauuuuauauacccugguugcaaauuagaauguuuuaaaaauaucuuuaaccacguuaaaacaauuugaacaaaaucuuaccccaucuaaaaaugauaguguuuaguugaauuuaaguuaagcucuuuaguauaugaccauaugaagggguaaaguuuuaaucuuuuuuguuauuuacaugugaaaauacagaaacuaagugauugaaucacauccuacacgaaaguuuuuggagugcuccaggcauaucaugugaaauacagagguauuuauaucucuuuuggcaccaauaguucuugcuucaguaauucaccaguagguuuucauucaucgauaauauaucaguuuaaggcuaaaauaaaacaccuacauuucuuagggcuuaucauucuauauagaaagaggaaacauccuaaugaguuuuuucuuuuguuuuuccaaagagauucuaagcaaaaaaauuuuaacuaacaucuauauuuuguuauuggagcuaguuaccuuucuuuuucuuagauucuuuaacguuuugaguagauagccauauuugauaagcagguuggaugcuucuguugcuuaggagguagguguauuguguuauaugaagacagaaugaauuuaaauauacccaguuuggcaguaugaaaaagcucagacuacauaaaacuuggagguauggaaccuuuggacgcauuaaaguuaacguuucauuaggcaaugugccuuuguuugacugguguguaaguccuucuuccagguuuguacgcucuuaaacgcguuauucuacccucucuaacuccucccagcagcaaaagggagacacuucagcuggaacaaaauaguggaagaaauggcgucugggguucaguggggauucgcaguguguaugcaauguuugcaagauuauuuuuuauguuuuucaauuacuguaaauaaaaauauaucaaugcuuagugucaagaagggaacauuguauaccaguauaaacucucuuagugggucugcaaguugcuuaaccucucggggccucaguuuucucaucugcaauaugaaggaguuggacucgauaaucuuuaaaguccauuccugcucuaaaauccuaugcuuuucugaaguacucuauuuaacagaaugcauugcuuucucacuuugacuauuugaauuauguaugcaguacacuuacugcaacugcauguugucuaaaauaguuuuucuauaggauguauauaaaaacuaaucccucuugagcugauuuauaauguguguauauagccacacauaaaaagcuaguaauaguagggcucucagaaaauacuuuccaguugucuaaccuugaauguuauuaacucuucuauauuacaggagauacaacucgucaacgaaucaaauucagugaugacagaguaugcaagagucaccuucucaacuguuguccucaugauguccuuucuggaacuguauguauuuacuaaauguauuguuagauuacugauaugcugcaguaaugaacuacuugauaaagucuuaauucugugucaaaagaauugacuugugaggggagauuugcauccuuuauuguuuguuuauucaggaugauuacuuaaaucuucaguaauggguuuccucacaaaagugguugauacguuuuguuuuauaauuuuuuccauucuucagagcaguuuuuuaaaagcauguuuuauuuggaauacagaaguaguuauauagcauuuguacuuuuaguucagaaauaaaauaauuuauuuuuaaaguuccuuuuacuguuaaacagaguagacuuuuaucuaguacgguauacauuuuuguuaagauuuguacacauuuguggaaucaguggggaaauauauuaguaaauacuuauauccacacagcuuaauuugggaguauugucacuuaaaauauugcuccugcuaauaauguaaagcucaauuuagauucuaugucugcagagauguugaucuuagaguaucaucguuuuaauuuggaagauaaacugcaugaugauggaccuguuggaauguggaacagagaauuugauucucugaauuuuggauuugguugaaaugauuacaaguagcuucccuucauaguugcaucugaugcugguggggagcuaguaggggcuaaaccucgagcuggcuuuaguucucauuugccagaaaugacugaaaugaagaaagauuucugacuugccuuuucagaagcaaugaguuucucagccaaaugagugguuucuucuuugauaggaagaguuaaaauuaaggacaugccccaaagagagauguaucaaggcauaugcaacaggaaacaccuuugacuuuuuccaggaggaaagacaguugaaacuauauuauguuaacggggaaaaaagagccuaaguuuauuuuaaaguauaauacuacaaagcaagaaauccaguuucugagcacaggaauuuggaaggacugugacagauaauaaauauaauaaacucuaaacucuuuauuuauuuauuuauuuuuucugauacagagucuugcucugucacccaggcuuggcgugcaguggcgcaaucucagcucacugcuaccuccacugccuggcuucaagcgauucuccugccucagccuccgguguagcuggaaucacaggcgcgugccaccaugcccggcuaauuuuuguguguuuauuuuuauuuauuuauuuauuuugagacggagucuugcucuucuugucacccaagcuggagugcgguggcaugaucuuggcuuauugcagccucugccuccuggguucaagcgauucuccugccucagccucccaacuagcugggauuacaggugcccaccaccaugcccaacuaauuuuuguauuuuuaguagagaugaaguuucgucauguuggccaggcuggucucgaacuucugaccucgugauccacccgccuuggccucccaaaguacugggauuacaggcaugagccaccgugcccggcccuaauuuuuguauuuuuaguagagacgggguuucaccaugucggucaggcuggucuugaacuccugaccucuugauuuguccaccucagccucccaaagugcuggaauuacaggcaugagcuaccgcgccuggcuuuuuuuuuuuuuuuuuuuuuugagacaagagucuugcucugucagccaggcugugaacacugcccacugcagccuccaccucccgggcucaagaguuucucccaccucaaccucccaaguagguggagcuacaggcacacaccaccaugcucggcuaauuuuuguauuuuuuguagagacuaggucucaccauguuacccaggcuugucucaaacucuuggcuucaagugauccuccugccucagccucccaaaguacugggauuacaagcgugacccacugcaccuggccauaauaaacuccuuuaucuacuuucuaacauuuucguaauuauuuuauaccgugugcuaugcugcaucugaaaucuaugaaaucuaucauugucuauaguauacugugauucuccauguuuaauauuguauaaaauuuaacuuuauuuaauuuaaaaaauuuacuuuuaauuuuuauuuaauggcuaaauuacuacuugagauaaauuuugagaacaacauuaacaaaaccacuugaggccaggaguuugagacuagccuggucaacauagugaaaccccaucucuacaaaaagaauuaaaaaaaaaauuagccuggcauggugguauuuccugaaguccuaacugccugggaggcuaagacaggaggaaugcuugagcucaggaauucaagacuucaagugagcugugaucacaccaguguacucuacccugggcaacagagugagacccugccucaaaaaaaagaaaaaagaaaaaucaacaguuacaauucaguguuuuucauucuucauuuaacaucagaaaagaaauaggcaucuugaacauaaagagguguaaacuaucacacucugucccaaaaagcauuuguucuuuagggauugacugcuaagaagccauagcucuguaauuauaagcuauuuguacauagggugaacuguuaaguuuuucagguccuuaaggacaccauuguaugacacuuucggagucucacaacguccuuuacgugguccucaaaacucugcuuaaauucugaaagguucacaacucaaguaauccuccuacuucagccuuccaaagcacuaggacuacaggcaggagccacugugccuggccuuaacuguugauuuuaugaugcuuuuucuuuguuguguaccuaaagauuguaugacuaaagguugcccuuuaguuuguauuuuuaguagagacgggguuucaccauguuggucgggcuggucuugaacucuugaccucuugaucuguucgccucagccucccaaagugcuggaauuacaggugugauuaggugugccuaagaucugucacuugcagcagaauaugauuuaccaguauuuuagguuauuuagaaaaagaauacagaaaagccaggcaugguuguacauacuuauagccccagcuacuuuggaggcugaggugggaagguugccugaacucaggauuucaaagguagccgggacaacauaguaagacucugucacaaaggaaaaaaguauccagaaaugcauuuccugccuuuuuuuuuuucucauuauaaagagguuggaacuuuauaucaagcacuuagagauggagagugugauuucuaaauauucucuucauaauugacaaguuaguuuggaauuuuuugcaauugaguuucaugaaaaugcacuuacaacauuuuaccuuucauuauucuaguauaacuaaugcuuuuuuuuuuuuuuuuuuuuuuuuuuuuuuuuuuuuuugagacagauacucgcucuguuggcccggguggagugcaguggcaugaucucggcucacugcaaccuccgccuccagguucaagugauucugccucagccucccgaguagcugggauuacaggcaugcaccacuacacccagcuaauuuuugcauuuuuaguagagacaggguuucaucuuguuggccaggcugguuuugaacuccugaccucaguugaucugccugccucggccuccuaaagugcugcaaugauaggccugagccacugugccuggucuggcauaacuaauucuuaaaauaauaaauuaaucagggcugggcguggugguucacgccuguaaucccagcaguuugggaggccgaucacuugaggucaggaguuugagaccagccuggccaaccaacauggugaaaccccaucucuacugaaaauacaaaaaauuagccgggcguaguggcccgcaccuguaaucccagcuacucgggaagcugaggcaggagaaauacuugaacccuggagguaaagguugcagugagccgagaucacaccacugcacuccagucugggugacagagcaagacucugucucaaaauaaauuaauaaauuaaucagaggagguaaaacagaacagaggaucaaaauaauuauacguuuaaugauuuuuauaagaaauaugaauauuuucuuuaucucagaaaguuacuauacuucaaaagcuugcggcuaggcucaguggcucaugccuauaaucccagcacuuugggaggccgaggggggaugggggaucauccaaggucaggaguucgagaccagccuggccaacauguugaaauccugucucugcuaaaaauacaaaaaaaguagccgggcaugguggcaggugccugugauuccagcugcucgggaggcugaggcaggagaaucgcucaaacccuggagguggagguugcagugagcugagauugugccacugcacuccagccugagcaaaagagcgagacaccguuuaaaaaaauaauaauaaaauaagaagcuuggauuauuuuucuauucuucuagaauauauucauauuguagucucucucuuuuccucauuuuggcccacuuucucccugcuaaacucacuguaggcaguaugcccuuucagauuuaggcaaaacaaaaaaaccuaaaccaagcugucauuuuuuuccucaacacauuucuucugguacguaucuucccugaggaaagauaaagaaauugacaugcuuuaaaaaauauuuccaucuaguuccuagugaucgggaaaaaagauacaugacuaauaauuuauaguagacuuuaaauauaaagcaaagauguuaacagaaacuugaaauuaagaucuuaggacauggcaaauguauacucucauaguauguguguucaaaauucagaaaucagcaccacuaauuuuaugauagcccucaucauagcguaacuuuacuguugauaggcccucauaucuucuaguguaaagucaucauuuuacaguucagaaaaacuaaggcuuagagaaauugugcuguuaaaugucucaauaaaaaaaaaccacaguauucuauaccauuuaggaaucuuaaaucuagaaauacuuaaaacaauuuuuugucaguuuuuuagguaauucaguuauccagggcagugacuuucacauguuucugaaacauccuuggaggcagcucaugcacuaaggauuuaggaguaggcuaguucguucuauuucaacucaaauuuuacauauuuuauuuuauuuuauuuuauuuuuauuuuauuuuuuauuuuauuuuauuuuauuuuauuuuauuuuauuucauugagacagggucacacucuuggccaggcuggagugcaguggugccaucucggcucacugcaaccucugccuccugggaucaagcaagucucccgccucagccucccgaguagcugggauuacaaaugugcgccacuaggcucggcuaauuuuuuuuuucuuuuuuugagacagagucucgcucuguugcccaggcuggagugcaaugguuugaucucggcucacugcaaccucccacucccggguucaagugauuuuccuaccccagccucccaaguagcugagauuacagacacacgccaccaugccugccuaauuuuguauuuuuaguagagacgggguuuugccuuguuggucaggcuggucucgaacugcugaccucaggugaucugcccgccucacccucugagagugcugggauuacaggcaugagccacugcgccuggccuaauuuuuuuuuuuuuuuuuuuuuuuuugagucagauucuugcucugacaccaggcuggagugcaguggcacggucucggcucacugcaaccucagccucccagguucaagcgauucccuugccucagccucccgagcagcugggacuacaaggugcgccaccaggccuggcuaauuuuuuguauuuuuguauuuuaguagagauggaguuucaccauguuggccaggguggucucaaucuccugaccuugugacccgccuaccuuggccucccaaagugcugggauuacaggugugagccacugcccccagcuaguuuuuguauuuuuaauagagauuggguuuuaccauguugcccaggcaggucucaaacucuugaccucaagugaucugccugccuaagccucccaaaaagaaccaaucuuaaaaaauacuuacagauaggguuagggacuuugauauugucguagucaauauuauuggggacuuugauauugucacagucuuuauuuauuuauuuauuuuuugagacagucucucccugucacccaggcuggagugcaguggugcuaucuuagcucacugcaaccucucccuccugaguucgagugauuuuccugcuagucucccaaguagcuagaacaacagccacgcgcagccacagccggcuuauuuuuguguuuuuuuuguagagacgaaguuucacuuccaccauguuguccuggcuggcuggucucacacuccugggcucuagggauccaccagccuaggccucucaaagugcugggauuacaggaauuuggcaccaugcccaaccuaaaguaauuaaaguaaaaauguauuugcuuauuugaagugauuagaugggauuauugguugucagauauucugacugaauuuuauguugccccaguagguuccggguuuuaucccaggugcaccuuuuaugauuugaaacuccuuuuucuuauugcuucccugacucuguuuuaaagccugaucuaaaaaucaguuauguggguacauacaaacccaaacuuuaaaaacugcugaaguaucuuuuuuuuuuuggaggagucucccuuuguugcccaggcuggagugcacuggugucaccucagcucacugcaaccucugcuuccuaggcauaagcaauucuccugccucacccuuccaaguaggugggauuacaggcgcaugccaccaugccuggcuaauuuuuguauuuguauuuuuauuuuauuuauuuauuuuuuugagacggaguuuugcucuuguugcccaggauggagugcaguggcacgaucuuggcucaccgcaaccucugccucccagguucaagcaauucucccaccucagccucccaaguagcugggauuacaggcaugcgccaccacaccuggcuaauuuuuuuuguauuuuuaguagagacgggguuucuccaguuggucaggcuggucuugaacuccugaccucaggugauccgcccaucucggccucccaaaguggagaguaucuuggcuuuauuggauuuauuuauuuauuuauuuuuugagauggaguuuugcucuuguugcccaagcuggaguguaauggcgcgaucucggcucacuucaaccucugccucccgggcucaagcaauucuccugccucagccucccgaguagcugggauuagaggugcugcacgccaccaugccuggcuaauuguuuguauuuuuaguagaaacgggguuucaccauguuagccaggcuggucuugaacuccucaccucaggugauccgcccaccucggccuuccaaagugcugggauuacagaugaaagccaccgcgcccggccuugaugucuuuuuuuuuuucuuuuuucuuuuuuuuugugacggaguauugcucuuucgccuaggcuggagugcaguggugugaucucggcucacugcaaccuccgccuccuggguucaggugauucuccugccucagccucccgaguagcugggacuacaggugcccgcuaccaugccuggcuaauuauuauuauuauuauuauuuguauuuuuaguagagacaggauuuuaccacguuggccaggcugguuucgaacuccugaccugaagugacccacccaccuuggcgccucccaaagugcugggauuacaggugugagccaccuugccuggcccuggccuggauuucuuaucaaaauaugacaccagugguuaccugugcaaguaugaaaaaucagucuguaaauuguuuaacucuuuucccauaaaugguuuauuuugggcugccuugguauuauuuaaggguuuaaguauuauuuaacuaagauuaaaauuugaagagaucuggauguggagaucugauguuuuuggcauuaacccugauuauuggcuugauauuuagucaaauguauauauauuucauauauacuccaggcuggagugcaguggcgugaucguggcucacugcaaccucugccucucggguucaaccgauucuccugccucagccucccgaguagcuggcauuacaggcuugcaccaccaugccccgcuaauuuccaaauuuagguuugaaguguguucuuauuuuaagcagauuugcuguauuuuauuucucucagucuauuacaaaaauauauauucucaacuauuucuagagacugccuaaauaaaaaaugcauuuggugcccaggaaguuaacagugcuuuaaaagauugccagugaauaauuaaaauuuuacuauuaaaccuuaaaaaccaaggcuuuaaucguuuaaaacauuuuuggcaaauaggaacaagaauacucaaaaauaguaaacgggguacucacgcccuuuggaaauaauccuuuucugucauucugaauaauaauuuuuuuuaagaguugggggucucacuguguuguccaggcuggagugcaguggcuauuuguaggagcaaucauggugcaauacagccuugaacuccugggcucaguugauccuuccaacucagccuccuaaguagcugggacuacugcagaugcacaccaccauaucuggcucuauuuugaauaaucuuagaucauucauuuuauauacuauuuaaaauaacacaauucaggcuuauggagguagguaauuuuuuuccccauggugacccauaaaccauguauaguaauaucuuauucugguuuaguguuuguuucuaguugaggguugucagcacuuuuguguauuacuuguauuaauaaguacagauauacguucauauggguauggcggacuguaguguugauguuuauuuaaugaauuuucauguacccaucagcuagcuucaggaaauauuuuacacacagccuacuguauuuuauuuauaaucacauauauucccccugcagcuuuuuuuugaaggacaucuucaaaagucuugaaucuaucaguuaggauuacuuuuuuuuuuuuuuuuuuuuuuuuuuaaagaaacagguucucauucuggcacccaggcuggacugcagugguauaaucguagccagugcagucuugaacuccaggguucaagugauccuccugccucagccucccaaguagcaaggacugcaggcucaugccaccauucccagcuaauuuuaaaauuucuguagagagagacucucgccaugcuguccaggcucuucucaaacuccuggccucaagggauccucacaccugggccucucaaacaugcugggauauggaggugaacaacuguacccagcuguaagaugacucuugaaauuaaagaaaguaguaaaaaccaguuauucccaaacaaaguaggaggucuggaagucauugaagcagauuguuuuucauagucuaguacugguuaauauauuucagugucauauugauuucuuuguacaaugagucucaauaaaugcuuuuucccuaaggaucaggaauuauucucuuaguauuuccuggacccuccagauguuuuuuagagauaaguaguuuuaucaacuguauuuuaacacuucuaaggaaacaaguguguucuccgcaacuauuuguugaaaaagggaauauggaguuauaaauacaucauuuggaggauguaauucauugaacacaauaguaagaaaugaaaacuugaaaacaauaauuuuuuuuuuugagaccagagucuugaugugucucccaggcuggagugcaauggcacaaucuuggcucacugcagccuccaccucccaaguuccagugauucucaugccucagccuuccaaguagcugggauuacaggcacccaccaccacgccuggcuaauuuuuguauuuuuaguagagaugggguuucaccauguuggcuaagcuggucuuaacuccuggccucacguaauccaccugccuugaccucucaaagugcugggauuacaggccugagccacugugcccagccuaaaaauauucuuuauacaggcgauuaaccacaaacaucaagcacauuuacaaagaauuacaaaaucucugucacuggaaauauuuuucucugucacuggaaauuuuuuuuuuuuuuuuuugagauggagucucacucugucguccaggcuggagugcaguggugugaucuuggcuuacugcaagcuccgccucccggguucacaccauucuccuggcucagccucccuaguagcugggacuacaggcgccugccaccacaccuggcuaauuuuuuuuucguauuuuuaguagagacgggguuaccguguuagccaggauggucucgaucuccugaccucaugaucugcccaccucggccucccaaagugcugggauuacaggcaugagccaccacgcccggccacuggaaauauuuuuuaacaugugaugaguucaaccuuuaggcaagaccuaaaugcuuucuagcugauucuuacucauuaagggaacuucuaaaagcucauuaguguuuuacuuuaaccuauauaggauuaaaggauuagagcuuuuuuuugagacagaguuuugcucuuguuccccaggcuggagugcaauggcuugauuuuagcucacugcagccuccuccuucuggguucaagcgauucuccugccucauccuuucaaguagcuggauuacaggcacgugccaccaugcccggcuaauuuuuuguauuuguaguagagacaggguuucaccauguuggccaggcugguuuugaacuccuggccucaggugaucuaccugccucagccucccaaagugcugggauuacaggcaugagccaccgugcccggccagagcauuuugagaauacauggucucauaaacuuuuuuggcuugcaggaucaaaaauaaagauauguguugauuuuacucagauaauaugacuuguaaagcuggagugcaguggcgcgaucucggcucacugcaagcuccgccucccagguucacgccauucuccugccucagccucccgaguagcugggacugcaggcgccugccaccacgccuggcuauuuuuucguauauucaguagagacacgauuuuaccauguuggccaggcuggucuugaacuccugcucaccuuggccuuccaaagugcugggauuacaggugugagccacugcgccuggcugaaaauuuuuauuuuauuuauuuauuuuuuauacgagagcucuuguuuccugauggaaacaaaagaaacaaauggagaaaauuuucgaugaagugacauuugagaucgaauguggagaagaagguagucauuucugagugggaaucaacuugccauuuuguuccuacgcaaaacuuguggugguucuguauuguuuauaccuguacugaaaaaucuaaaauacuuacccaggcuacuucucccuugaaugaauaaaucguauaaguuguuuuuucuuuuccuuuuuuuuggagacagaaucuugcugugucaugcaggacugaagugcaguagugucauuauagcucacugaagccugaaacuccuggccucaagugauccuccugcuauggccucacaaaguguugggauugcaggcgugagccaccaugucuggccugguucucuuguuugaccaaacugauuuacuuauugucgucucacuccuuucuuucccucgcaugcuucucauuuuuguuuacacucuuuucuucugccugcaauauucuuucuccucucuacaaauuuaaauccuaucuggcuuacuauaugugauugccuuacccuguaacaauuuagccucugaaccccaguauagcaccugcuuucuguacuauugaaaaaaaauuuaucucauuuguguauauauucucauucucucucucuuuccaguuagauaguacaccauagucuuugugugauaagaccucuuguuuuaacuuuuucuaguuuucuuugcauaucuagggucagaaaugguuauaaaaauauuuccuauguucuuaagaaaauuacaaaaagguagaaaaauaucaugauuuaucuuuacuuugggaaaaauagguuuggagcuggaacauauacaagugggaagaggcaguuaagaaauugggaagugguagaaaagcagcagcguuauguaugcacaaugugccccauuucucuucacccuauacucaugucuaagguauacuuguuaacaugggggucagacuccguguucuuguguaauucguuagagcaucuucuggaaaaaugcuugagcuguaacuauggggaggaauauguauaacuuucauccuggaaaacuuggauaaagaaagccuguagugaauguagucauauaucuguaucauacuagaugcugcuacuuagauuuccuguuauuacaucaaaaucaucuuguccagaacaagacauuuucccucauagaucaguuuucccauuugauuuagucaguucucuugguggcaucauuguuuucucauguuugaaauacuugaaacccugaagagacuccugacuuuuuucuuuccacacuuaauuuccauuuagcuaauaccuguagguugaaaguuauuguguuauugaaagaauauugagcuauauuaaagaccuguugagauuuuuacucugcugccauuagcuuaugaucuuaggcaaauauugaucugucugagucuugauuuccauauuuguaagaaggugugaugggauucauuauuccagagacacuucacauuuuuuaaaugauuuuuuuuuuuuuuaauucuucggcacucugguuuaccucugucaccuccuuucuuuuuucucuucuaauuugaccccaguggcuuuauuccuagguucuuguaauaucuuuucuugcccuuugucucuuucuucuggucaauccaucuaguguuaaugguucugaaacauggauuuuauugugucguauuucugccugaguagucaagcauucuucuuugccuacagaauaaauucugcauuuuuuuugacucauuuucagacucuuucaccaucuagucagaggcuguaaacuaguggccugugggccaguauaauccuacauccccuuuuccccccaucauuuuccuuuaucuucuaguagaaaucuucucguuccaguuaaguuguuccucuuuauuuucccgauaggaaauacuguauucuccucuugaagcaugugcucuggcucuuucccucuauuauuugucuucuguguaaauuaucuucacuuguccuagaaaccuccucauacacacugauauuuaauaaagauagcccucuuuugugaauuugcuugaaaauggaagcauuagaaguagguaaaguuaugagccaaggaaauaaguuauucauugaacaaauauugagcuguaauauaauauuauaucauauuauguaacaaaauauugaguaccuauuaugugguggacuguguuaucugauuggggcuguuacaaugaucaagaaagacuauguuccucccucauugagcuuauaucccauugcaaucaauaugcaaaaauaaguagguugacagccugccuucagagugcuuuuauaaacaucuuacuugaucugaacagcaauccugaaguacuugagaaaacagaaguucagcuggcgcaggcaggaucacuugaggccaggaguuaccagccuggacaacauagcaagaucccaucucaaaaaaaaauuaacuugguguggcaugcacauguacuucuagcuagugaggagacuaaagugggaagaucacuuaagccuaggaauucaaggccgcagugagcuaugauugugccacugcacuccagguuggaaggucagagaguuuaagugaauuucucaggaucaaauggauaauacgagguaaagagagguguuuugaugugguccagugcccagucucucucucucucucucucucucuuuuuuucuuauuuuuuuuuuuauuuuuauuuuuuuuggagaccagggucucaaucugucccccaggcuggagugcaguggcgccaucuccacucaccacaaccucugccuccuggguucaagugauuuuccugccucagccucuugaguagcuaauuuuuguauuuuuaguagagaugggguuucgccauauuggccaggcuggucucaaacuucugaccucaagugauccaccugccucggccucccaaagugcugggguuacagacaugagccacugcgucuggccuagucugucuuauuacuuagacaauguaguuuuuuuuuuuuuuuugagacggagucucgcuuugucgcccaggcuggagugcaguggcacgaucucggcucacugcaagcuccaccucccagguucacgccauucuccugccucagccucccaaguagcugggacuauaggcgcccaccaccaugcccggcuaauuuuucuguauuuuuaguagagacgggauuucaccguguuagccaggauggucucgaucuccugaccucgugauucgcccgucucggccucccaaacugcugggauuacaggugugagccaccaugccgggccuagacaauguaguuuuuaaguacaggagaauaaagcauaaaacaugaauauuuccaauuauacaucacccuccuucucagaucuaaaccuugucaacaauuuaguguacaucuuucacucuccuuguguaaaugcuugugcacacaagcuuguguguuuuaacagaugccauuauauuguuugaauuuuuuucacuugucuuggagagguuuccauaucaguugucugcauuuuuaaaaaugccugaauaauauuguguaguguggcuguucucuuacaugcagugaguauuaauauauucauagucuuuguuucuguuuuugguguacacuguggcagucaaauccuuguauguacaucuuuguagacacuugcagcuguugcuuuaguuuaaggccuugauuuccauugugaauauaaauuccauaauaguagaaauuauauucucaugcuguucuguaauuuuguucaggaucugguucuuagaacugaacaaauguucaaacacauaacaaagcaguuauauuuacaauuacuuggagcuauuacuaugccaaauucuaucguuuauauauucauuaacauauuacuacuauuaauuuacacuuagcaguacacucaaaauguauaaaucaaccuuuugauuugcucuacuguaauaugucuauucguugauuuuaauguauaguuuucacaugccucucaauuuuuuuucucuaaaauuaaauuggcuucuuuuuuuuuggugggggggacagggucucagucugucacccaggcuagagggcagugacaugaucuuggcucacugcaaccucugccucccagguucaagugauucuucugccucagccuccugaguaguugggauuccaggcaugucaccaugcccagcuaauuuuuauauuuuugguagagacgggguuucaccauguuugccaggcuggucucgaacuccuggccucuagugaucugcuugccucaggcucccauagugcugggacuacaggugugagccaccacgcccggccuggcuucauugauuuuuccaauuguaguaauaaucaugcucauugcuuauaauucaaccaguacuagaaaguucaaacaacccucauaguaauauagauuuguaaauuccaaaauucguauuuuauuaugucuuucuuugccaccuucucuuuucuccacuugguauaucaagaacaucauuuuuaaaggcuaaauagacacuguauggcuauuccauagcugaaucaaccaaaccucuguugagaggcucuuaaaauguuucuucuuguauaaaaaacaacauuguuaaacuuuauucuccauuuaucuuuuuauaauuauuucacucuuaauuccuuagaaauagaauuccuuagucaaauuaucagguuuauucaguagucaugguuugugcaaaaccuggucuucugggagggauaaguaagaaaaauggaccauuuuucuaaugaagcuuaagaguuuauuuggggaaauaacauucacuuuuggaauuucaaaagaaaaguuaaaaauucuugacgauuuaacuuuguuaccuuuguuaguaaaacaauauaaaaugcuguggagcuauaaguuaccaggaucagguauaguuauuugguccacauuucaugcaguaauggauucagaauggagaagacaaaaugcagaacugaacuuaauuacaaauaagcauuuuuuaaaaaaucuacaaucuaagcauuuagauguaaaaauauuaaaaaccaagaauaagcuuguggaaggaauuuaauuaugaaguaaacuacuugucuuuuuuugagauggaguuucgcucuuguugcccaggcuggagugcaauggugugaucuuggcucaccgcaaccucugccccccagguucaagcuauucugccucagccucccgaguaguugggauuacaggcaugcaccaccacgcccggcuaauuuuguauuuuuuuaguagagacgagguuucuccauguuggucaggcuguucucaaacucccaaccucaggugaucugcccgccucggccucacaaagugcuggaauuauaggcgugagcaacugcacccagcaacuacuuguuaaauuaaaaaaaaaauuuuaagaccaggugugguggcucacgccuguaaucccagcacuuugggaggccgaggcgguugaauuaccugaggugaagaguuuuagaccagccaggccaacaugaugaaaccccaacucuacuaaaaauacaaaaauuagccaggugugguggugcacacuuguaaucccagcuaguagggaggccgaggcaggagaauugcuugaaccugggaggcagagguugcagugagcugagauugcaccacugcacuccagccugggcaacagagcgagacucugucuccaaaaaauuagccggguauggugaugugugccuguuggucccagcuacucaggugucagguggcuuaagcgggaggauugcuugacccugggagguaggguugcagugagcugagaucaugccauuguacuccagacugggggacagagugaggcccugucucuaaaaaaguaaaaauaaauaaauaaauaaucauauauuuugugacagagucuuacucuguuucccgggcuggagugcacgaucucagcucacugcaaaccucugccuccuggguucaagugauuauuguaccucauccuccugaguagcugggauuacaggugccugccacccuguccagcuauuuuuuguguuuuuaguagagaugggguuucaccguguugcccaggcuggucucaaacuucugaccucaaguaucugccugccuuggccucccaaggugcugggauuucaggagugagccaccacaccugaccauguuuuaaauuuuaaguacuucucaugugcauagcacagugccagaguagaugcuuaguagucaucaugguauggacagaggaauauagaugacuaguauucugaaaaucugccuuggcuauaccuacugucccacuaggucccugaagagauaaccacugaggauauuccacauacaaaaaagccuucuuuauuauaauuaggcccuugguccuagggcuuugacaccaaaaucuacuaugaugagucaggcuaggcuauaaacuugcaaggacuuagagcccagaaagugacaagcccaacuagccugccucuuggaggaaaaaagaagaauagcucaaaacacuuaagaagguaaggaguccaagcaaaagagauaauccaaggagaggcuaagaagaaccucccuccagaagcucagaucaguuuuguccuggaauucaucuugaccacucuggcuuguuaauaagccgcccugugccaaauguucuucuuugcccucuuuccuaguuugauuuauucaacauaggcacaucguagauaaaacagaagaauccuugcccuauggagcucacauuuuagugaguuaaucuuaccccucucaugcaucuuccccauggcaugccuuccccaaaaggcuacucucaccaaaaaguccaccucuacuauagugguaaaauuguaucuuucuuguguucauuuuguucuuagucuacauaguugcuuuucuuccuuugguugguugugugauguaacuuuaaagaaguggaggcagggagccuagaauuauugcaauagagacagagauguuuagguuaaaaacaaugaggcaaaauuuauguguuacuuuuaaguuuuuguugaauacggauuggaaauguaguugaucagggaacugaugaaaguaagauaaaggagauacggaagaaaggaaguagacagcugcuuugaaucucuguggugagcuuucuuagauguuguggggaaugacuuacugaaaaauauugaaagguaaguuaguacugaaauaaccggaacuagcaugguaaaguggaagcaauauuagacuaggaaucagucuaaccagauuuucugauaagcacccugagcaagucauucuuucugugcaaagaaugggacuaaaacuagaucagugagugguucucaacauugcacauuaaaaauaccuggggggcuuuuacaauucagucagucuuugggagguaggaauugggacuguuuuuuaaaagcuuccaucaauauuauguaaaaguuccccaggucuaaguugagaaccacaguggaucaaaaagucuuuccaacugugacaucuugcauuuuaugaaauaaaauagaauguagcaucaugugaacagcuauagcuuguggaaauaaaauauuaaggaaguuguuggcgugauugauguuuagaaauuguuaauuucagaaacguacugccuggcauaucaaagacaaugacagcauccuucugccauuagcuucuuucauuccuguuauauuuucuggaauucuuucuuaggaauauuuaaguuuuucugcauuuucuuaauaauuguuuaaugagcaccuuuuaaauuugaauuucuacacaucauagaaagcuuuacuuuuuguuuauugucacugaaaaacuccuuagcuuguuaaaccagacuaaugaaucgggggguaaggauuggagccuggaaaaaucucagcaugcucaguaacaguacaguacuuuaauaccauuaagcaugaugaggacuuuuauaacagugaugaguccucauuauuucccaaaggauaacugggggcagaauuuauacguucccauucauuccauuauauaauuaagaacugaagguaauauaguuuuacagaaaaacauuuucuguuuguuuuuacuuuugagacagggucuagcucugucacccaggcuggaaugcaguggcaugaucacagcuuacugcagcuuugaccuccagagcucaagugaucccccugccucugucuccucaggagcugggaccacaagcaugggccaccaugccuggauaauuuuuuucuuuuuuacuuuuuguagagacgggguuuucuuauguuacccaggccggucuggaacuccugggcuuaagugauccucccaccuuggccccccgaagugcugggauuauaggcauuagccacuguggccagaaacauuguguguuuuuuacuuuuuuuaauagucacaacaucuaagaguccgaaggaagaaaaaagcuaccugaugguugaauuauuuccuuaauauccuaauaaaaugguugucaaaacaguguuugaacaucucauuuaucugggaacucccuaacucugaggauguuuguucuaccuucagaaagcuuugauuauugaaaauauuuucuuggccaggugcaguugcucauaccuguaauccagcauugggaggcugaagugggaggaucacucaagcucaggaguuugagaccagccugggcaagauagcacccuuugucucuacuuaaaaaaaaaaauuagcuggauaugguggcgggggacgguggucccagcuacuugucggggaggggugcuuaggugggaggaucgcuugagcugggagguggaggcugcagugagccaugauuaugccacuacacuccagccuaggugacaaagugagaccuugucucaaaaaaagaagaaaaaguauucagagaguugaagucugacucauuggagucccuucgggccauaauaaaacaaaucuauuucugcugcuuuaugaaaaauuccucaguugauugaaguugguucacaucuuuugucuucucuauuuauuucuguucccuggcuuuuuugugcagccugguuuugagauacuuugucuaauuuucucauauuccuuuugaaauguguuaguacauagaauguguguuuuggagagcagugguuugcuuuuaaaaccagccuucaguagagaguuccuacuuuguuuauacuguguccucuuugaguuaguuuuagacaauauagauuuuucucaguugugccaugcuguaacuguuacucuugacuacuuacauuuuuaaaaugucugauucucugcucauaccuacuuauuuguaaauuuauugucuuggauauguaacuauaggacuucauauuuauuucuuuuaaauuuuaucuggucuauuaauacuuuugaaucuugaucucgugcauuagcuauccuuuuuaguugggauauuuuauaaaauuaauuaucauacguuuguuuuauacauauuuagguuguugacaaguuaaauaggcauacucauuuuuagauacuguauacaaagcuaaggcucagaccugugugccauacucuauuccuguucccuguuaccauaaacuucccugugauuaauaguggcauauaaauaaauaaauauuuuaaagaucugccuucuaaaucuucuguacaaccuggaacauuacuuuuugccuuuuccuaagauucauuugcuucucccucuuuagauccaguuuaauuguauccucuucagaaaggucuucucugaccaacucaucccaaguaggcccccauaauaauggggaacauugcuauuuuauuacaucaucugacuuuguucauagacaugauucuuguuauuuguuuccccucaaauagaauguaagcuccaugaagucagacugucugugucacuuaagucuauaucccuagcaccuaaaguagugcuuaccacaagugggaacuuaauagucaaaggaaggagaaugacuuguacucccuuuuuaccaacccuccagagauuuugagguauuccaaggguggucacaccuccaguuggaaaaucuccgccuugcuuucaucaccgauuaaucauaccuguaaugauccuugcaucuugccaauuuuuucucauauuuucccccaaaaaaguuucaugaaagaucuuaacaguugccuagauacauauaaaaauggauagauuuuuagauauuuugucucagauaugaggaaagccucugguuugguaaauaacaccuaauuggaauuuccaaguagaaggacccuagauucaguaagaguauuuauuucccugauacaugcuuauuauaagugggauuaaaugcuuguucucugugcacuuauguugggucuuacuaguaaaucaccucuuuacuaguuuauauggagucuuguccccagacaagacuauaucaaagucaacagucuuguuuuguuguggguuuuuaaaaauuuuuuauuuuuuaaaauugagacagguguuaguguguugcccaggcuaggcuggucucaaauuccugggcucaagcgauccuccugccuuggccuuccaaagugcugggauuacaggcaugagccaccaugccuggccaccagucugguuuuugaggacuccaucuuuauuugaaaaauaggauguucuucaaagcacauugacaucucaacaauuugauguauauauucuuuuaguuugguuuaaaauuaacuugaucuuuuuuguguuguggagcuaaaugaacuauguugugauauagaagcuagcuuuuuucagauucugaaaagcuuuuccauauccauuuauucuuaaauacaagugaucccuguucccaucuguugguagacaaaauuggugccauuuuuuucuucugacaccacguuuuauauuugucuaugaaauuuuguaauuuggaagccccuacauaaaaaagcaucuguaugacuuaauauguauucugacaagaacugugguuguugaagcauuuuuuaaaaaacuuuuuuuuguuuuaauauuaugucuuuuuucccuuccagagaauggaucuuggagaaugucugaaaguccaugaccuggcuuuaagagcggauuaugaaauugcauccaaagaacaagauuuuuucuuugaacuugauguaugugauuuugcuuuaaugguuuguuguuaucuuuugcuguaaaacauugugaauguggauuaagaucucuuaauaggaaaaacucuuagcaguuuauccucugguuauaugaaggguaagacucaaguaagaucauguacuuucuugacaacucuuuuaaaaauaugaggugagacuguauuuuaagaaaauguguaacagucguaugauucauauauucuuuuggaaauuaagcauauucuucccaacaaaauaguaaugauuaaggaaauaucaagcaaauguaagcaacuaauuuauaguguauauaaggaccuaucuuuaguaauauacugaguuuuuacauucauauuuauuuuugaaucuacuuauauauauauauacauguauauauaguuggccccccauaucugucguugaaucuguagaaggaaccaacugggauuguaaauauuuagcagaagaaauggauuguugcauccguacugaacauguacagacauuuuguucuuguuauuauuccccaaacauuacaguauaacuguuuacauagcauuuacauuguauuagguauuauaaguaaucuggagacauuuuaaaguauaugggaggauguguacugggagauuauaugcaaguauuacaccauuuuauauuaaacgugcauucauggauuuugguauccgcugggucuccuggaaccaaucucccacagauacugagggacaugcauauggguguuugggggauuuuuuuuuuuuuuuuuuuuuuuuuuuuuuuuuuuuuugagacagagucucgcucuguagcccagacuggagugcaguggcccaaucucggcucacugcaaccucugccucccggguucaugcuguucugcugucucagccuaccgaguagccgggacuacaggcgccugccaccacacccagcuaauuuuuuguguuuuuaguagagacaggguuucaccguguuagcuaggauggucuugaucuccugaccgcgugauccgcccgccucagccucccaaaguguugggauuacaggcgugagccacggcacccggccguuugggggauauuaaggacaguguuuuuaaugaaaaaccaagaaauggaagacaccauuuagauaccuaaaaaagccugaaauguaacuuuauauugcuguuuuuauaugaaaaucguuugcauaaaaauaaaguuuuuuugcauauauauaaucagcauuacauaaaacauacuaaugugcauaaaucuuugauacauuuuauaagugaaauaauagauguuuuaaauuugguuuuaggagauaaaccaacaaacagguccucuugucuucugaauauccaagaauuucugcuaauggaaaugaaauuguuuucagaaauauaauuuacaacacauuuucccuacuuuuuuggugguuuuuggccuugcggggguauuuuuauauuuauaucuucugauuuaucagucuuuaacaaaucuauagccaggcgugguggcucguaaucccagcacuguaaucccagcacuuugggaggcuguaaucccagcacuuugggaggccgaggcagggguggaucaccuaaggucaguaguucaagaccagccuggccaacauggugaaaccccaucucuacuaaaaauacaaaaauuagccgggcaugguggugggugccuguaaucccagcuacucaggaggcugaggcaggagaaucacuugaacccgggagucagguugcagugagccuagaucaugccacugugcuccagcuugggggacagagcgagacucugucucaaaacacaaacagagaaaccaaaucuauuucauuaguucuaaacgcuuuucuuuuucugaggugcuaagaguucucuccugugguuucuucuggcauauuuuggcuucauuuuauagacuuuuaaguccucgauucaucucagauuuauucugguuuaaggaacugagauauggaucuagucuccccccaaccccacauagcuacuuagucacccaacacuauuugcugauuaguccaucuuuucucucacugcuuugagaugccaucuuuaucuuuacauaaggaaauuugaauagauuucuguugugauuuaaaaauuuucaaauuaaaagaaauuaacuauuuuuauguuaucacagauaaaagcuguuuaagaaaugauccuuauugcuuuucacauugaagaaauucuuggguuauccaacuauuuuuggaauucaaugugugcugaauaaauuuguauuuuuaguucaaacauuuguaucuugaauuaguuauauuucuguacaguaagauuuggaaguccaaacuugagaaugaauucuuaaaguuuacuuuuaaaugaacuauuaauuguagacauuaauaugugccucacaaaugucuuauauaaauauugaauuuuuauaguguagauacugcuaaaauucucaaugguuuauucucugaaaaaagauaaguuuuccugaugugcgagacucuugucucaaaaaaaaaaauucuaaagcaguuuggagaauuaaaagaaaaaaggguaaaaauguucggaaauacuuacuguuagcauuuuguauaguuuuccauuuuuucuguauuuucuuuuuguccauucagaucuagacuugcagcagauuuuucugucuuuauuuuacaaaauugggaucuuacugcauaacauuuguaauuugcuuuuuauuuacaaaugaauccugaacauuucuucauguccucaagugauuuuuuuugagacagucucauucugucacccaggcuagaaugcaguggugcgaucuuggcucacugcaaccucagccucccaggugcaagugauucuccugccucagccucccgaguagcugggauuacaggcgcgcacuaccaugccuggcuaauuuuuguauuuuuaguagagacgagguuucaccauguuggccagcguagucucaaacuccuaacuucaggugaucuaccugcuucggccucccaaagugcuggaauuauaggcgugacccaccacgcccagcuucuuuuuuuuuuuuuuuuaaugacagggucucgcugugucacccagacuggagugcaguggcaucaucagggcucacugcagccucagccucuuugggcccaaguguuccuuccgccucagccucccgagaagcugagacuacaggugugccccacccaccuggcuaaauuuggauuuuaaguagaggcagaguuucgccaaguuggccaggcuggccucaagugaucugucugccuuagccuccuaaagugcucaauuacugacgugagccaccgugccccaccaugguagcauuuuaaaaagcaaagugugauuuuuguaugaagauauuucugaauaaaauugacuuucugacaguaauugucuuuaauuaaacuuuguaggccauggaucaucugcagucauucauugcagauugugaucguagaacagaaguggccaagaaaagauuagcagaaacucaagaagagauuagugcugaaguagcagcaaagguaagaauuuuaaucauuucauuaguacaaaguauuauuucgacuccuuuuguuuaaguuuuuauuuugaaauaauuagauuugcaagagauugcaaagacauauacaaggaauucuguauacuuucuugucugccccaguguaaacaucuuauacaauauagugcaauaucaaauaaauugacauuggucuaauccuuauauuuuauucagauuuugccaguuaugcaugcauuuauuuguguaugcaugucuguauguauagcucugugcaguuuuuuuguuuuucuuuuuguuugagacagaguuuugcuguguugcccaggcuggaaugcagugguguaaucuuggcuugcugcaaucucugccuucugggcucaagucucgugccucagccuucugaguaacugggauuacaggugugcgucaccaggcccagcuaauuuuuuuuauuuuuagcagagacaggguuuugccauguuggccaggcuggucucaaacuucuggccucaagcgaucuacccaccuuggccucccaaagugcugggauuacaggugugagccaccacgccuggccagcucucugcaguuuaaucacauguguaauuacagccacaguuaggaugcuuaaguauaacauugccacaagacucccucauguuaccccuuuuauagcuacauccaucuuuacccccacccagcaucucuacccuuggcaaccacuaaccuauucucuaucucuguaguuauguuauuucauggaguguuacauaaaugaaauccuguguacgcuuuugagauuuggccuuuuucauuccauauaacuuucuugagauucauucaaguuguguguaucaguucauuccuuuuuauuucuccauuguacagauauaccacaguauuuuuauuugcuuuuaaaagcaaauguuaaaugucaauauuucaccuguaaguuauaaccacaguaauacauacauaaaguuaacaguaauuuuuuaauguuauccaguguauguuuauuuuucuuauagagucgauuuauuagaauccaaacaaggucuuuuauauugcauuuguugaugacuuauuacaacauaauuauauuccauucaguaugaucaaguguguuuuaugaaaaugcagaaugggagaaaaagaguuacccagguggaguuuagaugacaguauuaaaauaugguguucagauauguauauacaaaugaaaauagauuccaucguuugagaaaaggguugcuuuuagucaaccuuuucugaaaauucucugaagauggggacuggaaagacgggcauccugaaguacaaaggaucuaguaucucaugguuggaagagaucuguaagugcuugguagagccugaguuguauugguuguauugguuauccaucacuacacaaaugcuguauaacaaaccaccucaaagcucagugacuuaaaacacuauuuauuuagcccaugacucugcagucagugauuuaggcugaacuugacugagcaguuauucuuguuucagcugggcuuacucacaugccuugcaguccacuagaggaugcagagccaugcccagcaggcuagccuggccguguucucauaguggugguagaggugcagaagcaucaagccccaucacacaggccucuccuuuggucauguuugcuaccaucucaguaaccaaagcaaguucauggccaaauucagagucagaguacgaugguacacaauuacauggucaaggacauggauacagggaagaaagaagaguuuuggacaacaguuuagucauucaaugauacauuuaaaggaaaauaccauuugguagagagggaggauagugauaauagaauuggacucucauugagggaagaaauauuuuggguugaaggauauuugagaaguaaagacuauuaauuaaaccaguaaacugguuuguugggacuggaaacucauaccaaacuaaaaccuucggccgggcgugguggcucacaccuguaaucccagcacuuugugaggccaagguggguggaccacuuaaggucaggaguuugagaccagccuggccaccauggugaaacccuguuucuacaaaaacugcaaaauuagccaggcaugguggugcacgccuguaaucucagcuacgugggaggcugagacaggagaauugcuugaacccaggaggcagagguuguagugaacugaaaucauggcacugcacuccagccugggcgacagagcaagacuccaucucaaaaacaacaauaacaacaaaaaauuaaaaccuucuuugcuaacauauuauaauuggccauacagcaaagacuuuguggcccaaauaaugauuauauguauguuuuaugugccauuacaacaguaggaaugaacuaaguugcuaggaugaugauggugaugaggaagaggaacguauucuuucccaaggccagaguuaauccugguggaaagcuaaggacucauagaguggaguugccaggcgaguaugcugaaaaucagcaaggugcuaugcaggguacauacgaggcuuauuuucucauuucucacaacuuugugggauagguacuucuuagaugaggaaaugaauucagguauaaguaauguggccaaaauuacacagauaguaauugguuuagcaauaagucagaucugauggauuccugaacuugauccaccaauucauuucuuuaacucauauuugagccuaggcuauuugcugagcacuagagauacaaagaugggaaauacagauagcuguccuuaaaguaguaugauauuuaugaaaggaacugucaaaaaagauacaaaggugacacaaaggagagaguauggccaucuuugcugauguguuuaaguggggcugggauguggugacuguucaggaauguuuuacagaaauggcccuugaguuguaucuuguuggaacgagugaauauucaguaggcaggcgagagguaagggaucccaucccagaaagaagaguauaugcaaaguaacagagguagaaaacaacaggguaaguuuggggaaacuauaaauuauguugugaggugggggaguagcaagagaugguuuagaaaaguacaaagggccagaucauggaagaaaucguauuuuacacuaggaauacaccaccucgccagaggauagaaaguuauauugggcccaguaguagcccugacuucauugagguaaggcaggcaggcucagaacauccugaugucucaguaguucauuugggauacgcucagaaagcauucuuuaaccacauacugccuuagauaacaaguuuuuucucagcaguucugaaauacuuugaaauuuaaaauucauucucuuguuuauucaugaucuucuuuuuuauuucuuuuuaggcagaacguguucaugaguuaaaugaagaaauugguaaauuguuagccaagguggaacaacuaggagcugaagggaauguggaggaaucccagaaaguaauggaugaaguagagaaagcacgggcaaagaaaagagaagcagagguaaauucuuaauaguaguagacgaauucugcuuaauuugguaagacuacaaauaaaaaguaguagaugaaacuucaguaucuauacuucucuaagaacauguauuugaauggaaauuauugaacaguuguuaaagagaaguugaacuaaaagacaaaaacaaaacaaaacucggaaaaagcugguugugguggugcgugccuuuggucccagcuauuuugcaggcuaagguggaucgcuugaguccaguucaaguccagccuucuucuuuuuguuuuuuugagauggaguuuugcucuucuugcucaggcaggagugcaauggcaugaucucagcucaccgcaaccucugccucccggguucaagcgauucuccugccucagccucccaaguagcugggauuacaggcccaugccaccacaccuggcuaauauuuauauuuuuaguagagacaggguuucuccauguuggucaggcuggucuugaacacccaaccucaggugauccaccugccucggccucccaaagugcuaggauuacaggcaugaaccacugcaccagggccuuuuuuuuuuuuuuuuuuaagacagagucuuacucucucuccaaggcuggaguguaguggugcgaucucagcucacugaaaccucugcuuccuggguucaggcgauucucuugccucagccugcugaguagcugggacuacaggugugcaccaccaugcccggcuaauuuuuuguauuuuuaguagagauaggcuuucaccauguuggccaggcuggucuugaacuccugaccuggggugaucuguccaccucagccucccaaagugcugggauuacaggcgugagccacccggccuggccuguuuuuuuguuguuguuguuuuuuaaaauacuuuugguaaauuugucuuucagaaaaucucucuaaguuguauuuauugauauaaaguuguucauaguguucucuuuuaauaucuguagaauguuugcaauucgugucuuuucuuaauuaaucuagcuggucaguuuuauuuuguuuuucaaagaaccagucuucugauuuuauuguuuuuuucuuguuuucuauuucauugauuucuguucauguuuauuauuuccuuauacuccaguggagagaggcgcuaaggauagaggauggggauaaagggaaccuauaauuuucauaacaaaauagccaugcuuuugugguuuuuuuuuuuuuuuuuuuuugagcuggagucucgccccagugagccaccgugcccagccacuuuuguguauuuuuuagaaaacacuuuugguauaagcauaguauauuuuauuuaauuguaugacuuuuagugagauuuauauggucauuguuuuucucacuuuuguuuaggaaguuuaucggaauucuaugccagcuuccaguuuucagcagcagaaacuucgagucugugaagucugcucugccuauuuaggacuucaugauaaugacagacgacuggcugaucauuuuggggguaaacugcaccugggauuuauugaaauaagagagaagcuugaagaauuaaagguacauugguaaaauauuccucacuuuauccucuuguucuuuugaucuguaucaguugccuuuuuguacaauauucuugacuaugauucaguaauauaguaucuaaugauuaauacuaaacaguguaggauuauagauggaaauucaaguugguuuaauggaugcugccugagaaacagacuuaauauuauccuguuauuuugggaguuaccauuuuauauuagauaugacaccgaguuagggaucuuucaaacuaguuacuaaaagagucccauaaaacuucauuguuauuguucuuuucaauaaggucaauaagaauguaauaauauaauauuuauaagaaguuugagaaaaugaacccaauauuaauuugaaauauuuugcaauucuuuauuaaauagcaagcuugcagaaucucuaguuuuauuuuaugcuccugcuuccacuucagaaaggacuuaugaaaaaauuuauauuuuuuuaaaaggacaaucacuauuacuuaaauaauauaggcuuuuguggggaagacaacacaguuuuuacucuuguuguuuagaggggauaaacacaaaaaagcauggugauauuucugaagugguaaagaugaguguugguggauauaaucuauuuaccuuuuaauaugcugauagcuuuuuaagaauuguggcacuguaguguuuuuucaugaauugaggucuggcugacagauaggaaacaugggauagucauuuucuuuguaacuguuauugucaacuggaauuaacucaagguccauagcauuuaaaauaauauagaaucagaaaaugccuagggacaucuccauauucucagguaacagugggcucuuuucaguauucugaguagcuagggugaucucaaguaauuuuuuaaaaauuucgaaaagagucacuauagcaaauaguuacuaggcuccaaguuaaaacuccagugguuccuacuugggagucuuugcagauagaccuagcaacagaacucaagcauuuuacucauaucuuuaaaaagcagcagcaucaggaugguaauuggaagugaccuaaauauuuccauauuagaaaucacagggcaugggaacuugugauuuauaaugguugauguuuuuuuaaaaaauacaaaauaauacuagaaaacauuuagaggaggaaaaucuuguagaagugacuuggaaaugucauuaagaaaucaugaaaggcuaggcgcaguggcucacgccuguaauccuagcacuuugggaggccaaggcgggcggaucacaaggucaggaguucgagaccagucuggccaauauggugaaauccugucucuacuaaaaauauaaaaauuagcugggugugguggcaugugccuguagucccagcuacucuggagacugaggcaggagaaucacuugaacccgggagguggagguugcagugagcugagauugugccacugcacuccaaccugggcgacagagcgagacucugucucaaaaaaaaaaaaaaaaagucauggagcuggguaugguggcuuaugccuguaaucccagcacuuugggaugccaagguggccagaucacuugaggccaggaguuggagaccagccugggcaacauggugaaaccccaucuccacuaaaaaauauuaauagaaaaauuagcuggguguggugaugcacgccuguaaucccagcuccucagguggcugaggcuggcagguggagguugcagugagccgagauggugcuacugcacuccagucugggcaacagaguaagacugucucuaaaaaaaaaauaauaagaucauaggccagucucaguggcucgcaccuguuaauuccaacacuuugggaggcugaggugggaggaucacuggagcccaggaguuguagacccaucugggcaacauagcgagauucugucucuauuuuaaaauaauuuguuuucacuuaaaaaaaaaaacaaaaaaaaaaaccaaguagaaaucauggagaaaggugaaauuuuacacauuuuccacaaaauggggaaagauuauggaaagaagacuuguaggccuaaugauuauuucuggcaguacuucaaauugaauuauuaaacagauuuugacagcaguuguacuguauuagaaaccagauaauauaaaguuuaggauaaagcuguuuaagaauggacucaguaaauauucuccucauuuauuacuguuuuuaagagagucguagcugagaagcaggagaaaagaaaccaggaacggcugaaacgaagagaagagagagagagagaagaaagggagaagcugaggagguauggaguaaugggccaaguaauugaaguugaaucucugugguucuaaaaagagauauaauugauuuuaaauuuuagauggugauaaaucuguuaugggacgugggaaacuucugcuuacuuuaaaaaauauuacugugcgaauuauauaaauguuuaauuauacaaguaucguaacucuuggccauuuaacggaaugugauuuccuuuaaaauguguggaagagugaauaaagaaugcuucguaucuuguaagauuuauaacaaaauccagccgggcaugguggcucacgccuguaauuccagcacuuugggaggccgaggcggguggaucacgaggucaggagaucgagaccauccuggcuaacacggugaaaccccgacucuacuaaaaauacaaaaaauuagcugggcgagguggcgggcgccuguagucccagcugcgcgggaggcugaggcaggagaauggcgugaaccugggggggcagagccugcagugagcugagaucgggccacugcacuccagccugggcgacagcgagacucugucucaaaaaaaaaaaaagauuuauaacaaaauccuuuucuagcccuuugauuuuucauauugggcuagauuugcaccagguuagcauagaauuauuauuuuuuuuuuaugauguauuuuguuaacaaaagguuuaagggugguuguuucauugaaggguuuuuuuuacauugaacuuugguuaguuccucaauucuaggagccauaaacuauuaaaaagucuaaaaauaucuaaauguauauaauuccucuuacauugguauucauuaauugauaaaaucuuagaauucuaguauuuggaaugucuaaacauucuucugagucacuuuuaccauuggcagcuaaaaucacauagcaucaugguggcaacauuuuuuuguaacucaucuuuuuaacuucagcagcuuuaggauggacaguuauaucacaaaugauuugccuguaguccuaauuuauaguguuccuugaaucauacuacauuuaaaugucuuaaauuuaaauaccuucucuuuagaguuagcagaugugcuuaagcuaauuaaaacccuuuguaguauuagguuaugcucacuuccuucgaucuuugagcauauuauauacucaguauauuucaagaaguuuaaacagacuucguuugugucacauggcuuauaaccagguaaucuuuuugcaccauaaagacagugaaacaaaacuacaugucuauauggucccuuuuuaggagaagugaugucaguccucuauugagagagagagauuucuucauuuacuguaaaguuuaccucagagcuuuuaucuacuuguucuuuuguguauaguaaguccuuaugggaauauugcccaguauucuaauauauaaguggaauuuucaguaauauugggaaucucauuuuaagauucaauugaggugacaguaacauggaacagaauuucuuugcaggacuacauuuucacauuuguagaugaugaaaaaguauaucacaucuuacuccuuuguuugccaaauggcaaguuucuuuugacagugauuauauaaugcaaauuucagaaacauuaaaaaaaagucguugaaucugugagcuuaaagaaauauggaaguauggaagaugaggaaauuagaaacuaguauaaaauuauauaagaugggauaaaagaaaaaaaucauaaucauuuacugggugcuuauuguaugccagacacuguaguaaggaauuuauccauauucaucuaaucuuuauaaaccccacccccacuccaccccaguaaaauuuauauuaguaucccucuuuugcuagugacagaguaagcugagagaggauauguaacuuacuuaggucacacagacagugaaugguagaaccagaaauaaaacucaaaucuggcugaucucaaagucaugcuuucaacaaugcuauauaucauccaaaaaaaaauaauaaucccugugguguccuacuagccauaauauucacuuuacauuucauugagcguuaccugugugcuaggaaaugugacaagugccuuaaguagaguaucucauuucauuugaagaaacacauuguaagauugaacuagguguucuagagauuauaguaugagguuguagcuccaagaguauguagaucucagaccauagaaauuucacucuuuucccagaagggaaaaaagaaaugacagauauaaaagaauuuuuuccaagcugguaagugguuucuggaaaauuagcaaguugugauauguagguugagcaucccaaauccaaaaaaugaaauccagugagcuucaaaaucugaaacuucuugagugcuggcagcauuuaaaggagaugcuuauuagggcauuucagauuuugguuucuggauuuagggaugcugaaccaguaaauuauaaugcagacacuucaaauuuugaaaaaaaucggccaccuguaaucccagcacuucggaaggccaaggugguuggaucauuugcauccaggaguucaagaccacccuaggcaacaaaaaauguaaaaauuaaaaaaaaaaaaaacaaaaacaaaaaacagaaaaaauccgaaacacuuaugauccuuagcguuucggagaaggaguacucaaccuguacuguguuuuaaucuccuaggaacauauucuuuaagagccagguauucuugaguuaagcaaacccugcaaggugaagaaaucugucgaguuuguggugucuuuuggaaaauuuugugugcguagguacacgccuuguauuuauaaaauuaauguaaacauuagaaaucaggaagaauauaauguaacacugcacuguuuucuuauuuauagccacuuuucuaaaaauacauauuuuuuuuuuuuaggucccgaucacacagcaagaauccaaaaagguagguguauuacauaagacagguauaaguagugaaguugucuuuuucaaagguaguuuuuauagauugauuaaaugguccuuuaaaaauuuucuuuuuuggcugggcacggugaugcaugcuuguaaucccagcuacucaagaggcugaggcagaauugcuugaagccgggaggcagagguugcagugagccaagauagcaccacugcacuccagccugggcaacagaauaggacucugucuuuaaaaaaaaaaaaaaaaaaaaaaagaaaauuuuuuuugaaaucauuuagaugcucagaguagauacguaaaaggauuaauuuuuuaaaaaucaauuugggugguacauuuaggaaacauguucuaagagguuguagcuguugaaaacauuaguagguuaauaguuggauaaaauuuugauugauccacuguggguuaagcaaaaccaaaauguuuaguauacccuccagucuugacuuuaugugaguuuauuacccauuccuuuauacagugaucacagaaggcuuucagagaggcauuugcagccuuaaaagagcaagacaauacuuuguuuugacuuucagcguuaauauuugggguuugaaaccuuucuuuguaguuuuugcuaguugcugauacauuuuuuugucugagaaaggcagggaaauguguuguacuucaucauucuuucucaguucuucacuugcccuucucauuccagucguugagcuuucuucauggauccauucccaccuagaaugcccuuucucagucuuuuccaaauucuaccauuccucuuguucagaucacaucuucuuuuagaaacuuucugaguucucagcucuagagacuauuucccaagaaguuuucccuaaaaaguagagaauuuguuguuaugaaagaaaaaccuggcugagcgcagugccucacgcuuauaccaucacagcucuuugggaggccgaggcagccagaucaccugaagucaggaguucgagaccagccuggccaacauggcgaaacuccaucucuacuaaaaacacaaaaauuagccgggugugguggcaggugccuguaaucccagcuacuugagaggcugaggcaggagaaucacuugaacccaggagguggagguuacaguaagccgagauugugccacugcauuccagcuugggugacagaguaagacugucucaaaaaaagaaaaacaaaaaccuuacaguucuguuagcaacaucuaucaaugauauuucugccuaaaacacuaaaaaaacuaaagaacauuaauaaguggggccaguugugucagcuaauuuauauuauuggugaauuucucugaucuagcaugauaaguagaaacauuaaacugugauacuguuauuguuuacuguuugauuaauauaagcuggucccuuuguugaaaacauaaaguauugcacauagaacaucuuuagauauuugggccagaaauuuaauuucuauuccucuaguccuguuaccuagauaauauguuugccuuguaacugggcuccuuaguucucugugcuugcccaccccccuucuucaccucauucuauuuuucacacgucagccaggaugagccuuuaaauaaaugaaauacaucacaucagcccucugauucuccaaagguuuuucaucucauucauaugagaaguuaacaucuuuaccaaagcuuuuacauagggugacgguguggccugggguguccaaucuuuuggcuuaccugggccacacaucagauacacuaaugauaacugaugagcuggaaaaaaaauugcaaagaaaucucauaauauuuuaagaaaguuuacaaauuuguguugggcuguauucaaagccauccugggcagcaugcggcuuggaggccgcagguuggacaagcuuggcauagcccaaacugcccugggauaguucugguuuaugucuuuuaucccagaauauguauuaauagcuucucauuacauucaguaacuuauucagagccuucuaguuugaaugauaaaguaccuggucauccugccuguaagacccugauauuacuuccuuuugcucacuucauuccagccacacuggucuuuuccuucaacaugcugagcuuuuucccaccucagggacuuugcaucuguguucccucagccugaagcacuccucucugagaugacugauucacuuguucccuuucuucuuucagcuuugcuucagugccaaccuaucagaaaagccuucccugcuuauuccguauaaauauuuccacucuuuucucuuuuuccacucuacguaauaacaucuuuuaauuuuuuuuugagacggagucuugcucuguugcccaggcuggagugcaguggcaaaaugccagcucacugcaaccuccgccucccagguucaagugauucuucuaccuuaggcucccuaguagcuaggauuauaggcacgugccaccaugcccugcuaaguuuuuuuuuuuuuuuuuuuuuuuuuuuuuguauuuuuaguagaguagggguuucaccauguuggccaggcuggucuugaacuccugaccucaagugauccgccugccucagccuuccaaaguguugggauuacaggcaugagucaccauguccagcaauagaucuuuuuuuuuuuucuuaaccaccugacauaucuuuauuuacugccuacaaaccuguauagaucccuuucuauaguauaagcacuaaguuuagugcaggaacuuuguuuuacuugcuacucaaccuccccuaguauagaacagugcaaaaauaccuagugaauauuuuuuggaugaaaaaauuaccuagaauuuuuaaaaagaugaauaaaguuauacauuggaagaaauggcauucauaauaacucaaaaugagugguuaaacgaaguaugauuugauaaaacuuacacugagaguuuuauauuuuuucccucugcuuccuuuuggaauuacucuuuucagcuguggaaauaacgcuuuuuuuuuuuuuuuuuuuuugagacagggucucacucuguccugaguagcugggaccacaggcgugugccaccauguccagcuaauuuuuaaaaauuuauuguagauacggggucucccuauguugcucaggcuggucuugaacuccucccguuuaaggauuaagcaguccucccauuguggccuccccaagugcugggauuacagacacaagcuauugugcccagccagaaauacucuuuuuaaguguggcuaaagcuacguccaugucauguaccuuucuuugacuauaauguugacauaagcugaaugccuuuuagcaucguucauaacaaucaguugaagauaaacuguauuuguaaacuaucucauauguauaauaugauuuugaacuugcuguaucaaauuaugagcaaaccucacauucuuaaagugacuuaaauuuaagaguuuuauugagguauaaaauauauauauauauauauauauauauauauauauauauauauauauauaugauuuacucugaagucagugauuuuuuagcagauuuaaagcugugcaacuaucaccauaauccaguugagaacauuuccaucauucuuaaagugacucuucuaacaaaguugcauuccuuuguuuccccuuguuuucugucaaacguuuauguccucuccaugccauuuccacccucaccaugcacccccacccaccccacaaguuaguuugugaccugguggaggcuauaaaagugucuuaccuuguggguuuuuuucuuuucaaaaaaugucuuuauuuugccagcaccuugaucguauauuuucugguuuuucagaauguuuuucguucucuauuucuguguauucauuagaaauacauuuuuuuugcaaucugagucaaguucucaaaaaugauuuucgcaaguguucuuucucccaaacuguuugcuccuugaauagagaacugucuuacuguguuuguuuugucuugcucucuauugcccaggcuggaaugcaguggugugaacacagcucccuguagccuugacuuccugggcuugggugaucauccuuccuuagccucccaaagugcugggauuaaaggcgugagcuacuaccccuggcccuuacucuguuuugauuacacugugacuagacaugcauauugugggcauuaaaaacuuacuucuaugguuaucucaccuuucuaauucagacaaagaguaauuuguccugacguauucuuccucaucucuucucuucccuucuguccaggucugucagguacauauuuaauuucuagaggauacaaaaauguucaagauauuuaagugcaauuaaauucauaacaaaucuagauaauauagccccuggcauauaguagugguucaaaaguugcuuucacuugaaaaacuauuucugauaauaaauuuauacauuacugauugcucucugagaauuaucaaucagugucuuguuuuugagacagaauuucacucuuuugcccaggcuggacugcagcgaugugaucaccaggucauugcagcagccuugaccucccuggcucaagagauucucucaccucagcuuccugaguagcugggacuacaggcaugugccucuguguccagcuaauuuuuguauguuuuauagagacagaguuucgccauguugccuaggcuggucuugaaauccugagcucaagcgauccuccugccucagacucccaaaguguugggauuacaggugugagccacggcgccuggcugagaauuauuaauguuuuauuuugaauucuaguauguaguuauuaacacaccagcaauucaguguagauuuagcugacuuggaauauaauugacauuaagacuacugaaaaaaaguuucucuuuaaagaaaaggcuuuaauaaaugagaaauauaguaauuacaaagguagaaacaaaaucaaaucuugucugguagauccagguccagagagcaucgcagacaucgaucucgcuccaugucacgugaacgcaagaggagaacucgauccaaaucucgggagaaacgccaucgccacaggucccgcuccagcagccguagccgcagccguagccaccagagaagucggcacaguucuagagauaggagcagagaacgauccaagaggagguauugaugugucaaucagaggauauggagcuaccuuaauguuuuagaguuguuuauguuuacuuauguuacuuauguuuagaguucagauuauugguuugaaacuuuugcaucugguaauauguacacauuuauguguggguguacaacauuuuucugugauuauauggguaguuuugaaagaauauacuuaugagccagagcaagaaauuggaaccaauauguguagagguuauugcuuuucucugcuuagugugucuuggaaaaaaguucuuuacagguaaauaauuuuaaauaccaauacccuuaguauggaucagcaaauuaggggcucugagaaguccuuucauuacaagaguuguuuagcuuugauuuauuguuuucuaaacuuauuugagcugggaugcuuuuucagagcagacacauucuaguauauucuuguuuuaucugcacuauagauauguauuguuacauaccuucagcuuggcaaggcagacuaauaaggagguuccaagacuucccuugguuuaaugagaacauucaaaaggugcaggcauaggguaagguauguuugaggacuugaauaucuauuaaggauagacaaaggauuauaaugugguagaagaguuuagcauucauagucuguauagaucaaacugucaaaacuucucaggucacaugauggcccuuaaaccagguaauuucuguguaacguaagccauguuuaaaauugcuuuuuucuugacaacuauucagaaguauauguaugauaaacauuuuuugagugccuaguaccuacuagucuuacauauucuguggauuacuccacauaaaaucuauaauaaaauccacagaaagcuguuaaaaucuuuccuauuuuuuuuugacucaacuuuccauucccugaaaucacucacaagcugaguuuguuaauaggcucucaauauuuuauuucuuauauucuggccuuguuuuuaguauuucuuaaggugauuuuaauaauaauuaauuguauauguuuuacuguacuagacuuaguaaaacauaagaaagacguauaacauaguugaacaacuuuaaguugcucuaagaaguuuccuaugugaggcugggugccauggcucacgcuuauaaucccagcacuuugggagaccgagaugggcguaucacuugagaucaggaguucaagaccagccuggccaaccaaccccaucucuacuaaaauacaaacauuagccgggcaugguggcacaugccuguaaucccagcuacucaggaggcugaggaaggagaauugcuugaacacaaagguggagguugcagugagccaagaucgcaccacugcacuccagccugggugacagagcgagacuccagcucucaaaacaaaaaaaaacaaacaaaaaaaaaaacaaaaagucuccuaugugaguuagaacaaaggauugacaucuuugacaauaauuagacuggcauaagacuaccacauguuauaaagugcuaaacugcauaucauagaauaaaugauccgagaguuuagaugaggcaaauaacagaguaaucaaaaauggcuucagguagucgguaaaauuugaacagguagaaucagcuaggaaaaagauauuccauauagagugaauauccuaggcaaaugcagagaaugaggagggaguuuguaaaggacagagugauuuguaggccucuuaucucacacucuugaaacugauuuugggggucuacccucagugcaguguucagaaauaagcauuuuuuaaaaguuaccugucuuaucugcacaaugaauuuucagaauuauccugcuaggugauggaagguuuagacauuuuccugugucaaaucugcccaacugucauuguuguugcugaacuccuaaaugucuuuauuggugauggguaugggaaggaugggcgugaaguccccuaaucugagauuguguuauuuuagucccugaugcuuccugcguugaugaaguuguauaggaauuuuuccaccauacaugauacaugaucauaucuaagaugucagcauguucauaaagaggauuauuuuuguaaaacuauuaaaaguuuugcuuuucucgagcacuuucucaucuuugaauucaaauuauucucuuuuaaagcaucauucuuuguuuuauacuaaaaauuaccagauaauugcuguuaaaaccuacuugguauuucauacaacaucaaguuauugcuacauauuuggguuuaauuuuucaagguaaaaguucuuauugaaagccuuuuauguuuugcuguucuccuuucccuacugugaaauacuugucucugauacaaguagauucuuugugaccucuuccuggcaauagugcccugcguaaaugaggaccauuugcaucuaucuaucuuuuugcucuguucaaacauguuuagugcagacuccaaagucagauuacuuggguucauugguuuaggcuaaguaauuuauuuuuuuuuuugagacgagagucucguucugucacccaggcuggagggcaguggcgcgaucucggcucguugcaaccucugccuugcggguucaagcgauucuuuugccucggccucccaaguagcugggauuacaggcccaggccaccacaccuggcuauuuuuguauuuuuaguagggacaggguuacgccauguuggccgggcuggucucaaacucccgaccucaggugauccaccugccuuggccucccaaaaugcugggauuacaggcaugagccaccacgucccaccuuggcuaaguaauuuauaacuaucucaccugucuuuccccaucuacuaaguggagaaaguaagaauaccugcuuuguuaagauuauugguaguuugaguaaaauaguauauggaaaccacuaugugugggacauaguaguugauacucauaguuuuuuaguuauuacugaucacugggacuguuuggcaucuagugucuuuuuagguaucauuuuuaccaucucuuuucauauuuuauuccaacaaaggcuauggauaggacuaguguagacguggaaucacuagacuuggcacugugauuuuuuguuguuguugagauggagucuugcucugucacccaggcuggagugcaguaaugcgaucugggcucacugcagccuccgccucccagguucaagugauucuccugccucagccucccgaguagcugggacuacaggcacacgccaccacucucagcuaauuuuuuguauuuuaaguagagacggggguuucacuauguuggcuaggcuggucuugaacuccugaccucaagugaucugccugccuuggccucccaaagugcugggauuacaggcgugagucaccgugcccagucuuuuuauaucauuuuaaguuuauuaaaacauuaaguagaauguucaaaguggacauuauuuuagaaccauuuuuuguuuaacccuccuuaacuauauuucuaaaacugaacagucauauuuuuuauuuuccugaaaguauuacuuauucagguucuugguagugccucagauccuaauuuugaauauggguugagugagauaauuauguaaaagugcugugucaccuguaaagaaccaaauaaauguaauuuguugaauuuuagauguuggaaguauggaagauuccauguuuauucugauuccauaauauguuugguuuuccgauugauuuauuauuuaccuuucuuauaaugaaguuggguaugggaauggagaagguaguaaacaguuauggcuaaucaagauuuauuagugugagcaucuuugucuuuuuuuauuuccccuuguugguugaauaagcuaacucaguaugaguagauuuuuagaagugguuauuuaaauucauauuaauaauugaguaguucucuuaucuaagucagguguuggcaaacuguugccgauaggccaaaucuggccgguagccuguacaaccagcaagcuauggaugguuuuuacauucuaaaaagaaaagaacugccacaaagauugcauggaccugcaguaccccagauagucaccaucuggccccuauucuaagccauuuaaaauuuagauaauacauuucuuucacuuuuuaaagcuguuaucuauguauuauuuuuuauauuaaaauaccuuuuaugaauuggagaaacucuguguugucucugagaugagaguagccuguaagaaauuauuuuagccuucugacccucugcuauuuguuuuucacccaucuucuuguuuuaaugcccuuaucaacuaugguagugcucuguaauuugucagaaaacugacuccucugucauggguauauucgucuauauaucuucagcuaucaagagcuuaauauuuauccuauucuuuaauuuggguuuuuggguuucccaacauauuuugcuccucaaauuaauauuuuucagauccucaaaagaaagauucagagaccaagacuuagcaucaugugacagagacaggaguucaagagacagaucaccucgugacagagaucggaaagauaagaagcgguccuaugagagugcuaauggcagaucagaagacaggaggagcucugaagagcgcgaagcaggggagaucuaacuagcuguguacauuucuucaguccuuaagcuuccuacggaguuacguacuauuguuuaguucacagcuguucagggugacagugagcagauccagacaccagauccagcuaggcuagauguacaguaucuaacuugaucugaacugaaccuguuuuccuugaugaugccuaaaacuacauccauaguuucuggugaaccuguaauacaguucugaaaguacaguuuuauauaauaagaugcugaucucuuuauucuuucaaguaagagugcuagugaacaaauuguguuacuugccuugggauuuuuugaacguuuguaaaaugcugucuuccuaguccaaacagcugcagcuuugggcauuuuucuuuuuaauuauucuuccucugacuuuguaucccuuaauaccuacacucuccaauuguaagagaaagggggcagggaagcaauauagcuuccauucuaaggcuguauucccguuaugaauuacuagcugauuacaguucagagcauugauccuggaaugugugcuggagaaauuuaaaauacugggguuuuuuguuuaauggugccuauuuagaguuggaaguugaacagcuguugcauuacauacuuuugcuuuuuuauugaaauuuugaaaucaaacgucuugauuuuucuguucuguugaauugcuauguucaggauguucuagggggugggggcagggacucuuuucguaauaagcacuuguuuuauuuuguguguguggaguauaaaggcuacacccuuauuguaaaaaaauaauaauaauaaaaugaaagaaacaaucaccaccaccauuauuaaacuguaacuugucuaguaaauugucacuagaacuauuugcugugggcauuuccucuauucuguuacgucauuaacagugccuuacugugcaaggcaccaaaggacauaaauacguacuugcaaagauuccagaugagcuguucaugugggccccuugcugacuauauuccagccacuucaggguuguuuguaaugaccguuauagagaagggcucgaccugcagaagaaacugggguguuuuuauucucauucaacaaacccaaauaaaaacaguauauguaaccaacau

SEQ ID NO: 191602 - RNA, 64760 nt, Homo sapiens
aggggugagcuggcggcgggggaggcgggcagcggagccaagcugacccggcgagcggagccggggcuggagagcggcgaccacugcggaucucgggugcgcaagcggugaugcguggggccgaagaccugcuggggcgggggcggguccaauccgaggggcuucccgggucgggagggcgguggggagauguagguggcggccccccuuggguggggcgcccaggcagggucggccgcucgcccccuccuucuccucccugggcccgggccuggggucccggccgucacggggaggcugcgaugggguggauggggaggagaaggacccccgggggacccugcggcccggccccgauccaugcggcagaggcuuuugugcuccucgcccgccuguccuccggccgugggucugggagauucugacuugaucagaaaagggcuugucguucggaccaggggagaggggaugcuuuucagguagguggggaaggaagcucuuuggaaaggauguauagaggucagagaagaagcguggucucagugagugacugguuuuguuuucugguaacuagcaugaacucagucaaggaauuuggucaaauuauucgucauucccuccuuauucuucgcaggguguguucuguuuauucucaguuuugacaggagauaaugggaauguguccccggaguuuuuaguguuuuuuugaaauguaagaugguaggcuaucucgugguaacucuuacugaaaaguuuauaguuuauagggaggagugguuccuggggugagcaaaaucauucaguuguuaucuuuuuguccaccgguuuauuucuaccuuuacacaaauuuauacauacauaaauauauauaacaguuguugaagggaaugucuucagugcuuuggugcuuaaaugauuucuuuucaguuuguuugauguuucuuggauacuaggcucuauacuaagaacuccauauaaauuaucucauuuaauuaauacaugaggaaauugagcuucggguugggcgcggugucucaugccuguaaucccagcacuuugggaggccgaggccuguggauuccuugaggucaggaguucaagaccagccuggccaacauggugaaaccccgucucuacuaaaaauacaaagauuagcugggcgucguggcgcaugccuguaaucccagcuacucgggaggcugaggcaggagaaucgcuugaaccugggaggcggagguugcagugagccgagaucacaccacugcacuccagccugggugacagagccagacucugucuuuuuuuuuuuugagacugaguuuuuguucuugucgcccaggcuggagugccguggcaccaucucggcucacugcaaccuccgccucccggguucaagugauucuccugccucagccucccgaguagcugggacuacaggcgcccgccaccacgccaggcuaauuuuuggauuuuuaguagggacgggguuucaccauauuggccaugaugaucuggaucuccugaccucgugguccgccugccuuggccucccaaagcgcuguaauuacaggcgugagccacugcgcccggccucagacucugucaaaaaaaaaaaaacaaaaaaaaaaacagaaauugagauucagagaagcuacuuuuaaguggagggucuuagauuccauaccuggcuugucucuugaaugacaccauucuucuauuaguguuugauuucgagucucugccuaagaaggugacccggaaacaauacuuuuauaaaaguuaagucaacaguaucuugcugcuuucuagcugucaggaucaacugccuuguucauuguuuaagguucugauuugugcucuguucaucaguguuaaugucaugucacugcagugaccauuaacuugauuauaaauccuuugguagaagagggaaagauuuuuaucuugaaaacuaguugucuuuggaacauguccaaaaacagggaggaagaaugugguuuuggaaacccuggaauaaaaugagagauauuuacagauaaaugccaaguauuuuaugccugugguaaugagauaauuuaagaagagauaaaaauuacaggaagacggaugaauuaaugaauaaaaaggauuuaugagguucaaguaaauggcuucguaugagauaaugugggauaaaaaagauacuuguggcugggugcaguggcucaugcccauaauccuagggcuuugggaggcugaggcaggaggaucuaucucuuaaggccaggaauuuaagaccagacugguuaacauagcaagacccuguuucuacaaaaacuaagaaaauuagccaggugugauggugcccaccuguagucccagcaacuuuggaggcugaggcaggaggaucgcuuaaaccuaggaaggagauugaggcugcagugaacuaugaucacgccacugcacuccagccuggguaacagagugagacccugucucugaaaaaaaaaaaaagauaguuguaugagugugagcauugagacgcuaaacugcaacauauacaauacuguaaaaauggugaacucaacuauacauuuaauaauuucccacauucuucuuuacacuuugaaaacacauaaucuuuuuacugugcagacauaaaaacugaagucugggaggugaguaauugcccaucuaaugccccucuccuuugaguguguaagagaaccacucuuaccaguaagauguuuuuuuuccccauccuugguauauaccucugaguuuaggugugcuaguucuuuuauuuauuuauuuauuuauuuuuugagacagagucuugcucuguugcccagguuggagagcaguagggggaucucgguucacugcaaccuccgccuccuggguucaagcaauucuccuguuucagccucccaaguagcugggauuacaggcacccaccaccacaccuggccaauuuuuguguuuuuaguagagacaggguuucgccauauucgccaggguggucuagaacuccugaccucaaaugauccaccugccuuggccucccaaagugcugggauuacaggugugagccaccgcacccagccuauuuuuauuuuuuuauagcucuuuuuuuuuuuuuuuuuuuuuuuuaauuugagauggagucucgcuuugucaccaaggcuggagugcaguggcaccaucucagcucacugcagccuccgccucccggguucaagcaguucucugccucagccucccaagcagcugggauuauaggugcccaccaccacaccuggcuaauuuuuauauuuuuaguagagacgggguuucaccauuuuggccaggcuggucuugaacuccuaaccucgugauccaccugccuuggccucccaaaguguucagguuacaggcaugagccacugugcccggcuuuauagcucuuuuuuaaugcaugaagggugugauaguucuaacuauuguauuuuauccagcuuggaguauuuucuauuuuaaccuuuacccuuaaaugauauaacauaggaucuagaauuagaucugaguuggaaugugcacuccaucguuugagagagauugcuuucuuuuuuaaaaaauuuuaugagggcugggcacaguagcucacaccuguaaucccagcacuuugggaggcugaggcaggcggaucacgaggucagggguucgagaccagccuugccaauauggugaaacccugucucuacuaaaaauacaaaaauuagcuggacgugguggugcaugccuguagucccagcuacucaagaggcugaggcagaagaaucgcaugaaccugggaggcggagguugcaguaagccaagaucacgccacugcccuccagccugggcgacagagcgagacccuguuuuuuuuucagauggagucucgcucugucgcccaggcuggagugcaguggugcagucauggcucacugcugccucagccucccaggcucaagugauccucccaccucagccucccaaguagauagggccacagguguccgccaccacaacuggcugauuuuuguauuuuuuguagagaugaaugaggucucccuauguugccaagguuggucuuaaacucuugagcuuaagugauccucccaccuuggccucccaaagugcugggauuauaggcgugagccacuggaccagaccuagagauuacuuucuaauaucuguuuucucaucuguaaaacauugagagaacuaaaugcaguaaugcaugguagguaccuagcauggugccuaguacuuuguaagcauucaguguucugcugucagucaaccaauucauugauucaaaaaaaaacuuuuuuuuuugauauggggucucacucuguugcccaggcuggagugcaauggugcaaccuuggcucacuucagucuccaccuaccggguucaagcgauccucccgccuccaccucucgaguagcugggacuacaggugugcaccagcaugccccgcugauuuuuguauuuuuuguagagacaggguuucaccauauugcucaggcuggucccgaacucgugggcucaagccgucugucugccuuggccucccaaacuguugagauuacaagugugagccaucgcgcccggcccaaaaaaucuuuauugaucguucucagugcucugcuggguccuguggauguggcugugagacucaggacacagagagccacugcuuuuauggagcuuacagaugaacaguagacauggaaacaauuaaaccagauaacugggagagaugcucugaaggaaagaaauggcgaaagagaugagagagguaguaaccaggggagaccauuuuagauaggguuaucagggagcucacucuagggggugacauuucauugacuagccaagaaaaggaaggagcaagccauuugccaagaagcaggacaaaaacacuccucucguggaagaacaaacacaaagcccgaagcaagaggaggcuugauggguucagggacaggagagggauuugguguggggaguugguguuggugagggugggagguaggugggcacaguagaaaggagacaagcuagauccucaccaggcggccuggcaaaggauugggaaccacccagcugcccagugggggccugguuaaauaucuaaagauuccuucaugucagugaggacggcgcacguguucagcucugcaggugcugauauggauggaccuccaaccucuggcaagugaagaaaaugcacaacagauagugugugcugugugcuugcaugugugaucuugggggcucugccugguaugugugcagaggcacagauugugccccugaaggaaagagagaagaugugaaagaaacugguuaggagaucaggguggacugaggacacaggaggaaguuguauccuuugaguuuuuuuuuugggacggagucuugcucugucacccaggcuggaguacaguggcgcgaucucagcucacugcaaccuccaccuccuggguucaagcgauucuccugcuucagccuccugaguagcugggauuacaggcgcaugccacugcuucuggauaauuuuuguauuuuuaguagagacauaguuucaucauguuggcccggcuggucucaaacuccugaccucaggugauccgcccaccucagccucccaaaaugcugagauuacaggugugagccacugcacccagccauaucuuuugauuuauaccuuaggcauauaauaccaguugaaaaguaaugaaauaaaacaaaacccaaccucugcaguuuagauauuggcucaggcaggcuccuccuccaucuguaccaacccaucugucagcccugucccuccccagcccuaagcguccuauuuaccugcagagguuagacaggcuuuaaaggcuguggcaaagaaucugucuuuuugucucagucuugggaaggcaguaaaggguuuuaagcagaagcugucaagguaggcagguaggagaugcugcuggugguuuaucuuagggcgguggcagugaggauggagagaagaggguggcggugaagaggaccagaaccgagaggcuggggagugagcuuauccaucuggaggcugggauuugggauauauuuuggaggugaaaaggacuggauuuaguaauggguuggauguagaaguuaagggaaaagaaguaaaggcuaccucauaguuaccuugguugacuauaaggaauggcaguaccuuugcugagauagggaauaccaaggguuguugcaggugguuagcgacuaucugggcugguggagguuacacggacaccuuucagucccacuggaguauagcuccagccaggaccuucaguuaucuuccugcuuagaugcuguccacugagaguuccaaguugggaaagagaaagggaggggagaggguuuuccguaaggagaguuccccauacaggccaccaaaauguugcaggugaucagugacuaucugggcuggugguguaggcagugagaagaauuuaccaagacaguuauagguauagaaaggcagauuuauuagagaaggucugagaguauguuugcaaggaagcaacaggcaggucagcaagagaggagcugacugcaaggagauaaaagcuugcuggagauuuuauaggauggugcugugugcugaagagggcuuugugcaguacagauaacaauaagguugcauugagcuaacuugcauuuuucuaucagcugagugucuggugauuacugggugcaggaagauugugaguuacuugcucaggagggguauauguccuggaccacgaagaaaggcagacuuauaguuuaucugcuuauucuuuuuaguuuccccugaucccaccagccugacuccuuuuucucuaauuagaacuccacaggggagggauagauuuggagggagaaaugaagaguuguguuuuaucuuauuguuuaauuuuuugaaauggagucucacucugucgcccagaccggagugcaguggccugaucucggcucacugcaaccucugccucccgguuuuaagugauucuccugccucagccucccaaguagcugggauuacaaggcacacgccgccacaaccggcuaauuuuuguauuuuuaguagagacagaguuucacuauguuggccaggcuagccucgagcuccugaucucaagugaucuuccugccuuggccucccaaagugcugggauuacaggcaugagccacugugccuggccuaagaguucuguuuuagauuuuggagggauauuaauuggucauuuggauccuggagggucuaaguuagagccaugaaucugggaauuguugacauaaagguaugauaccagaggaaggaggagagaaagauguuggaaguuuaaaaagagaagugugaaaucgcugucacagguugagaaagcaaaauuacugggaagugugguaggcuugcugggcaguguugcaugcccuuugagguuugugguuuugaaucuaaaaagugaaaucagccugcuugagugauuuuucuguggcaaaacucagcugcuuuggugcagggaaggaggaggacagagacaaggaagggcacuguagauucuaaguugguaaggcaggaaaugaggacaggagggggauggaugagggaaaaacaaggcuacugaauugggagccuuguugaggucagaugacuguugaggugugguauauucagguaagugaucugcaaggaaaggaaguagaagauuugaaauccagcuaccaggcuucagccuuguguggguuuuuauugggggauggaggagaagggugguggugaagagaaccggaacugaaaaggcccaggagggagcuuauccaccuggcgguggggauggagguugggugaccaugggacgggagugcgagggagaucagucccugacaucuauggggaacagcaggcuauagagccccaaggugugaguuucaaagaagcuggggucuuggcaagaagagagcggcccagaaacggccuuggggaacaaagagaacauggaacgcuuguguccuugaggcauguagguugggggagggaagauugcaccucuugaaaggccuuaggggaagugaagguauagggagcacccggagucuugugaggauauagugccugcuaaccauguaacuagguuucuagagaggaaagauacgaggcuugcuaaccguguaucucuguuuccagagagcauggucaaaagggcuggggguggggugugugggaagacugggcagaugagaugaauggggcagaguggguaugugguagcuucauguaugucaucucuuuuacugcugaccacuccccugcccacucugcaguagacuuucuucagagaguuccuaauacgagacaguuggguuuuuuuguuuuguuuuguuuuuugaggcaggauuuuccucugucaccuaggcaggacugugguggcaucaucauagcucacuguagccuugaaggccuggccucaagugauccuccugccucagccuccccaguagcuaggacuacagugcaugccaccccaucuggcgaaauuuuaaauuuguuguagagacggggucuguugcccaggcugauauugaacuacuggccucaaaugauccucuugccuuggccucugaagaacagcuuugaauuuggguuggaaaggacucuaaauaccacuauagaaagugaaauuagaaauaauaauugggggaaauuuuauaucccaaagcagcguuguagaaggcagcguugccuuccaccuggacguguugcugcagugcgaagucaucuuuuacuuagcagugauugcgcacuauuguaaccgcccaguggguucaccuugccugcugccuagacagagccaauuuaucaagacaggggaacugcaauggcaaaacagugguucucacagagccggcuuugcaggagaugggaguuuuauuauuacucaaaucagucuccccgagcagucggggaucagaguuuuuaaaaauaauuuggcggguaggggcuugggaaguagggagugcugauuggucagguuggagaaggagucacugggggcugaagugagucuuucucucugucuucuguucccuggugggauggcagagcugguugagccagauuaccggucuggguggugucggcugaucuaucgagugcagggucuacaaaauaucuccagcacugaucuuagguuuuacaauagugauguuauccccaggagcaauuuggggagguucagaccccagagguugcaugaccccuaaauuguaauuucuaaucuuguagcuaauucguuaguccugcagaggcagacuggaccccaggcaagaagggggucuguuaucaguuuuguuucagugucaaaccaugaacugaauuccuuccuaaaguuaguucagccuaugcccaggaaugaacaaggaccuuccuuaaggguuaaaagcaagcuagagccaguuaguucugauuucuuucacugucauaauuuccucaguuauaguuuugcaaaggcgguuucacuauuguguuccauucuggaaauuaccauuuuuaauggguagucuucuaggacuaagaaaaacuucacuauaaaaaucacaaguuagugauugugaacuugcuuuggaaaguagaagauggcuuaaugguucuggauuuuuuuuuuuuaaagauggagucuugcucuuguugcccaggcuggagugcaguggcaugaucuuggcacugcaaccucugccucucagguucaagcgauucuccugccucagccuccugaguagcugggauuacaagcgcccgcuaccacgcccaacuaauuuuuguauuuuugguagagacgggguuucgccauguuggccaggcuggucucgaaccccugacuucgugauccuccugucucagccucccaaagugcugggauuccagacgugagccaccaugccuggccaaugguuuucuggauuuuauuugauggcaagaaucuugccaguauuuuuuuuuuuuucuggagagaauggaagcaaaggaauccuuucucuuuuuuuugguacagggucucacucugucgugcaggcuggaaugcaguggcacaaucucggcucacugaaaccgcuaccucccaggcucaagugauucucccaucucagccuccugaguagcugggacuacaggcacgcaccaccacaccuggcuacuuuuuguauuuuuucuggaaacgggguuuugccauguuucccaggcuggucucaaacuccugggcucaaguaguccucccaccucgaccucccaaauuacuggaauuucaggcaugagccaccaugucuguccagaaucuuauuuuuaacaaggauuuuuuuuuugucuuuuaaaauaauucuaauggggguuuggggagauguuggccaaaggauacaaaauuucaguuaggaggaauaaguugaagagaucuauuguacaauauggugacuauagguuuugcuuuuuugagacaggcccucacucugucacccaggcuggagugcaguggcacaaucacggcucacugagccucuaacucccaggugauccucccaucucagucucuggaguggcugggacuauaggcuugugccaucacacccgacuaauauauauauguuuauauauaauauauauaauauauuuauauuuauguauaauauauauaauauauuuauauuuauguauaauauauauaauauauuuauauuuauauaauauauaguauauuuauauaauauauauaguauauuuauauuuauauaauauauauaauauauuuauauauaauauauuuauauuuauauaauauauauauuuauauuuauauaauauauauauuuauuuagauggagucucagucuuuugcccaggcuggagugcaguggcgugauuucagcucaccgcagccuccaccuucuagguucaagugauuuucgugccucaaccucccgaguagcugggauuacaggcgugcaucaccacgcccggcuaauuuuuuguauuuuuaguagagaugggguuucgccacauuggccaggcuggucucgaacuccugaccucaagugauccaccugccuuggccucccaaagggcugggauuacaggugugagucacugcacccgaccuggcuaauauuuuuguauuuuuuuguagagaugggguuuugcuguguugcccaggcuggucugagacuccugaacuccagcaauccacccgccucggccucccaaauugcugauauuacaggccugugagccacugugagccacugugcccuaccggugacuauaguuaaugacaauguacucgauuuugaaaauugcuaaaagaguagauuuuaaguuuucucaccauaaaaaauaaguagugagguaauggauuuauuaacuagcuugauugagucauuccacaaugugcacauauuuuaaaauguguuguacaugauaaauauauauaauuguauuugucaauuaaaaauacuauaauguuaaaauucuuguugcugacaaauaucgguugauaauuguguauucaguauucauuaauagagucuacaaccauaccugcauaccacccugaacauggccugccuugucugacuuuggaagcuagguaugguggggucugguuagugcuugggugggacacugccugggaauaccgggugcuguaggcuuuaaaaaauaaaaauucaccgauugagaaaauacuaaaugacaagcuacagugaauucagaaacacugaaaugaaauuugguuuugaaauuugguuuuauuaauuauaacagcauuuacacauacuugaaaaauguuacacauuuguucaguguguauuuagagugguaaagagaguauucuucaaaaaguaggaugugcuugauggacucagacuugacaaaaacuccuguacaccccagggucccugagcucauggaugauuggaaaucacuucugugauagauaggauacaugugcaagguauuauuauuauuauuauuauuauuauuguaauugcauaggaccaaaugucguaguauucgucuuaaaugucauuaugcacacagcaggugaauguuuaaaacuauuuuccugggcgagguggcucacgcuuguagucucagcacuuuggaaggcugaggcggaaggauuccccgaggccaggaauucaagaccagccuggacaacauggcaaaacccugacuuaacauaaauacaaaaaauaagcuggaugugguggcaugugcgccuguauucccaaagaauugcuugagccugagaggucaaggcugcagugagcugagguugugccacugcacuccagucugggugacaaagugaaaccuugucucaauaaauaaauaaauaaauaaauaaggccaggcaugguggcucacaccugugaugccagcacuuugggaggccaagguggguggaucaucugagguuaggaguucgagaccagccuggccaacauggugaaaccccgucucuacuaaaaauacaaaaauuagccaggcaugauggcgggcgccugcaaugccagcuacucgagaggcugaggcaggagaaucucuugaaccugggaguuggagguugcagugggccgagaucgugccacugcauuccagccugggcaacagagccagacucugucucagaaauaaauaaauaaaagaaagaagaaaauaaagccuacuuuuccaaugugcuuauuaagccuuuucuccccaaucauuauagcuuaggaaaagauggucuauuuagaaacuacauccaaauggccucaaaugucuugguaguuuuuuaaagcuauuaauauaacuguacagcccuagguuaugcagcucuauugccaauguacuguaauuucaaucuguuggagcauuuauuuuuggaauuaugauuuuacaugauacaucauugaauuucauaucccaugcccuuuccuggaguacauacuacaguguuuugaggugggaagguguccaguucaaagagcuacgauucauagagaaugauuaaaguuuugaguuuuuccacuuggguuucauguuuaauuuucaggauggaaguaaauuuagucauaacacuaguaguucuuguuuuuguaacuuccuggaauuacagacaggaaguuuauuuacauuuugugaguggaauuuuauaguccuacucugcauguaauuuuauuaacauuucccaagaagaaugacuuuaaaaugaaauuagcuaaauucuacugauuuggaauuaauccuuggcagaucaguggcuaauauaauuaucugaauaugucacauacauuguuacuuuuagccuuacaacucucaaaugaaauaagccauuuuauggaugaccacuuaugauuuauagagcauggcuugucccaggggcuaacagcuaguaaggaaaacaacugucauguguacauaauuguaaccaccucaacuuuguuucuuuuaucuacaaguugcaagaauggccuuucugcugggucucuuagucuuuaagguuugggugcaucuguugagcuguggcuagugaaaauaaguaguguaacaguuccagugaacauagaucugagagccaagcccugugauucuuucuugaguauuggagcucuugaauguguucccuaccuugacuacuguuguagauuuaucauacaagccauuuuguggauuuuuucccuugaauaugaggauaaauuacauuacuuuuuuuggugcggcggggggcaggcaaggucuuacccugugguacaggcuggagugcaauggugcgaucauagcucccugccuccuugaaccccugggcucaagcaauccuccugccuuagccuccugaguagcugggaccauagacaugagccaccacgcuuggcuguuguuuuuuuuuuuuaguuuuuguagagauggggucucacuauguugcccaggcuguucucaaacucuuggacuuaaguguuccucccaccuuggccuaccaaaguguggggauuacaggcaugagccaacaugcccagccuaaaauauaguacuuuucuaaugcuguggguguuucccuuccauuauaaaaauuauauagauguuuauuauaggcuuuuuaagaaaguauauagaagaaaauuaaaauuauccaucauuucacuacccggagagaacuacuauauucccuauuuauuuguaaguauuaugugaacacaguuaauuagauuuauaaccggcucccacuuuuuuucacuugacauuuucucaugucauuaaaaagucuucgugacaaaugauuauaaaugauucagccauucagacauaccauaauuuauuuaauuauuccccuauuguuguauauuuggauugguucugcagacucauaacuggagacauuaaguuuagcugcuuacuuuaugcguaauuguucuuggauaucagagcaugggugcagcuuuuagagaguacagucaaaugaaaaggcauuggggccaggcacagugccuuaugccuguaaucccagcacuuuuggaggucaaggugggcagaucacuuugagcucaggaguucgagaccagccugggcaacaugaugaaaccauguuuccacaaaaaauauaaacauuagccaggcauggcggcucaugcuuauagucccagcuacuugggaggcugaagcuggagaaucgcuugagccugggaagcggagguugcagugagucgagaucgugccacuguaugccagccugggugacagagugagacccugucucaaaaauuaaaaaaaaagccacuggaaguaguggaaggagauggcaagggguggccugaccucuuucucuguuucuuugacacaaauuuuuucauuuuggggagauacuggggggcagacagggguuaggcagcuugcccagagucuugcagugggaccucaccucaaggcaauagaagaucauuuagaacauuguauuuaaucauuuuguuuuguuuugcuuagagucaggggucucacuuuguugcccaggguugacugcaguggcgugaucauagcucacuguaaccucgaacuccuggacucaagggaucuuccugucucagccucuccaguagcugggguacuacaggugugagccauugugcccagcuccuucuuucuuuuaauauuaaaaaucuccuccaacacuuugugaaaaauacuuuuguuuauaggccuaaacacaucuguauuuuuuaaggaauagaucccuggaaauucuuuuuuuuuuuuuuaagugaaagcaagcuuauucaaaaguaaaggaauaaaagggcagcuacugcauagagagagcagcccagaaauugaauuuuugugucaaacacucuugaugaacauggcuagauuguccuccuaugauauuauacuaauuuuuacuucuuucaguagcauaugggaguucaggaaccauuauacccugagcugcauugagcacaaucuucuuuaacuauccaaacgcuuucuugccuuaauuacauuucuaauauuacuagugggauugaacuuuuauuucucaaguuuaauagccauuucauuucuucugaguugucuauuuccuuugcucauuuuuucuauaagaaugagugauuuucuuaucaguuuguaugagcucuuucuauuaagauauaaucuuuuguccaggauuuuuuuuuuuuuuuuaagaacuaccuaauagcuuuaacauaauuacuaauccaguuuucuggugucaacuaggccauaagauuuuuuucccacaaggccugauuauauggugacuguaaaucuaaauaauacaguuuuuggauacucugccuauguuuaauaauguccauaauguguuuugucuuuccagaaggaagaaaugauguaaaucacucauccaaaccuuaaggucaaaggugagaaggaaggucaggaagaacauggccuggccaaauguuuuucaaagagggucucugcugucccaguucagccaucaucauguuguaguguuccugcucacuuucuucagguaagcauguugccaaagcugcucuccugcuuuuuuucuuuuuucuuuugagggagauauugcauggcaagugucaaaugcacugaugggcauacacuuauaauguuaguuauuccuucuguuguagucuugauagcuguaauaucguaguucuggagggcuguuuugcccuccagaggacauuuggcggugucuaagauaguuuugguggucaugaggggagaggaaugcuacuuguaguuagugguggagaccagggaugcuacuaaacguccucccaugcacaggacagcucuccacaacaaagaacguuucaucugcaaaugucaacaguguggaggcggagaagcccugaucuauuuuuuuuuuuauuuuguacuuuuuuuuuuuuaaaaaacauaucucacuuuuuuuuuuuuuuuuugagacggaguaucacuuugucgcccaggcuggagugcaguggcaugaccucagcucacugcaaccuccgccuccuggguucaagcuauucuccugccucagccucccgaguagcugggauuacaggugcgugucaccaugcccggcuacuaaauagagaugguuucacuguguuagccaggauagucucaaucuccugacuucguaaucugcccaccucggccucccaaagugcugggauuacaggcguuuauuuucaucacccuguuuggagagagaaguccucuauuuguuaaaagcaggagcuggagaacaaaggugaucuuaagugguucucuuaguaacauagcauacaucaggccauuggguguuagaggcaugcuguaagugaccuuguuacucagcuuuuuuugacauuucugcugaguagauuuuguuuauuaaucuuuaugaaaggcgccagaaauaaugauuauuuauuuauuuauuugagaugggaucucacccugucgcccagacuggagugcaguggugugaucacgguucacugcagccucgaacucccgggaucaaaugaucuacccgccucagccucuugaguagcugggaccacaaccaugagccaccaugccuggcuuauuauuauuuuuuauuauuauuauuuguagagaugaagucuucuuauguugccuaggcuggucuugaacuccugggcucaagcaauccucccaccucagccucccaaagugcugggacuauaggcgugagccaccgugcuuggcucauccuuuuuuuuuuuuuaaagagaagaauucuuggccaggcacgguggcucaugccuguaaucccagcacuuugggaggccgagguggguggaucaccugaggucaggaguucgagaccaaccuggccaacauggugaaaccccgucucuccuaaaaauacaaaaaucagcugggcgugauggcacgugccugugaucccagcuacucgggaggcugaggcaggagaauuggcuugaauccaggaggcugaguuugcagugagcugagaucacagcacugcacuccagccugggcaacagagcgagacucugucucaaaaaaaaaaaaaaaaagaagaagaagaauucuaaaauuguucagugucaugcuuauaauccuggcaauuugggaagccaaguggugggaggaucgcuugagcccaggaguuugagaccauccugggcaacauagcaagacucugucgcugcaaaaaauacagaaauuuuuguagccugaguagccuaaguagcuaagaugacaggugcacugggcgugguagagugccccuguaaucccagcuacucaggcugggcugggaggcuggcuugagcccaggaggugaagccuagugagcuaugaucauaacugcacucuagcuugagugacagagcgagauccugucucaaaaaauaaaaagaaauaaaauugagagagccucucugaaucuauuuugguucagguggcugcccaccaaauaaaauaaaauaaaauugaauaaaagaaaugggccuauaccugugauuuuauugaaugcuguuucucuuugcuauucauucaucuguauucucucuauuuuguaguuauucguugcuccaugcuucacgaaaaacauuuagcaaugucaaagucaguaucucugagcaguggaccccaagugcuuuuaacacgucaguugagcugccuguggagguaagcagaacagagugcugggauggaucgaaguaggagaccgugcccaccccuagauuguucuuaagcucuuuuuugcaucuuuuacuugccuagacucugaaauggcucacuguuuccuaucacauaagagccaaacuauucuaauuucaaagccugcucugacucagucccauuuuaccucuccagccggcuuguuucuaacuguugagaaaucacaccuuuugacaaggcuguuuuuucacuggcuuucguuagugcugugcucguuucugucuuugagauuuugcacauuaucuuuuaugugcucuuuugcccuuuuccaccuauuuaaaguuugccuuucucuuugugucaagauaaaauaucacuuuuuuuuuuuuuuuuaaacagaguaucauucuguugcccaggcuggaguggaacgaucucucagaaaacaucucugcaaccuccaccuucugggcucaagcgauccucccaccucagcccccugaguagcugggacuacagucgcgcaccaccaugcccagcuaaucuuuuuuuuuuuuuguagagaugggguuucaccacguugcccaggcuggucuugaacuccugagcucaagcaauccacccgccuuggccucccaaaggguugggauuauaaugugagccaucacgccuggguaaaaugccacguuuucaaucaaguuuuuucccaacuucugauuuuucccuucacuaaacucuuguacacugucuugcauauuguaaugucuugguauuucaauauuuucuaaugguuucuuuuuuuuuuuuuuucuugagacagagucucgcugugucgcccaggcuggagugcaguggugcgaucucagcucacugcaagcuccgccucccagguucacaccauuuuccugccucagccucccaaguagcugggaccacaggugcccgccaccacgccuggcuaauuuuuuuuguauuuuuaguagagacgggguuucaccauguuagccaggauggucucgaucuccugaucucaugaucugcccgccucggccuccccaaguguggggauuacagguaugagccaccaugccuggccuguuucuuuuuuuaauuuaaauuuuuuuguagagacagggucuugccguguuucccaggcuggucuugaacugggcucaagcaaucuuccuuccuuggcuucccaaaguuuuaggauuacagauaggagccacugugcccagccuguuucauuuguuuguaucuugcuuacgugccuugaagucaggcgugaucucggcucacugcaaccuccaccuccugggaucaagcgauucuccugccucagccuccugaguagcugggauuacaggcaugcaccaccaagccuggcuaauuuuuguauuuuuaguagagaagggguuucgccauguuggccaagcuagucuaauuccugaccucaagugaucugccugcuucggccuccccauaguguugguauuacaggcgugggccacugcgcccggccagaaucauaaaucuuuuuuuuuuuuuuugugagauggagucuugcucuaucgccaggcuggagugcgguggcaugaucucggcucacugcaacauccgccucccggguucaagcgauucuccugccucagccuccugaguagcugggacuacaggcgcaugccaccacgcccagcuaauuuuuguauuuuuagguagagacaggguuucaccauguuggccaggauggucuugaucucuugaccucgugauccuccugccucggcuucccaaagugcugggauuacaggugugagccaccgcucccggcccagaaucauaaaucuuaaagauggaaguggucuuagagagaucacguacccuaaccucccagauuggaaucuuucuuugucauucuuggaagauaaucauccagcuucugcuucaguaguuccaggcagaagaaacucacuguugugugagguggaugcuuacauuuuuauucaacuuuugaagaaaauuccucccugucucccuaaguuucuguuuaggcaaaacauuccuggcuccuucagcuguaguuuagugacacugagcacuaauugugggauuucagguacagccugaacaauauacagaaaaauaggauuucauuuaggcacuagauuucugguuguacugccuaaggcugccuuuauuuuuaagguaacuggguuggggguucccaagaccaccccuaguuuggugauuaacuaggaggacucaacauagaguacguguggcugucauuuauuccagugagaggauacaagguaaacucagcaaagggaagaggccggccuggcgugaggccaggccaagcuucccagaggccucucucauuaauuuuaaauaaaaaaauuuuuuuuaaauuauuuuuuaagagacggggcucuugcuauguugcccaggccguacuugaacucuugggcucaaacgauccuccugccucagccuccugaguagcugggacuacagguguaugccaccauggccagcuaaaaaaauauuuugcuuauauauuuuuaaaaguuaaaaaauuaaacagaaaaacauuucuuaagugcucuaaauagcauccuaaaaaguacuuuuuauagcuuucauuuuuaugcauagcucuggguguuuuacaaaaagaguucaguagacacaguuaccuuuagaauuuauaauggguucacugacaucgacaaacauuggaaauagugaguaaacauaauaacauaaagucuaugucuauagauaauaaucauuagaucuuauauuugagaacaacucagcuaaaaacuauaauaaaaauuuguacaguucuuacaugagaauagugcuagagaaucuaaaauuaucuccaggagaaggaaggagaauuuaaagugucuugggccaggugcgauggcucaggccuguaaucccaccacuuugggaggccuaggcaggaggauugcuugagcccaggaguuugagacuagucugggcaacauagagagaccaccgucucuacaaaaaugaaaacaaaaacaaaacaaaaaaaaaaacacuuugggaggccgaggcgggcauaucacuugaggucaggaguucgagaccagccuggccaacauggcgacauuccauucucuacuaaaaauacaaaaauuagcuggguauggugaugcaugccuguagucccagcuucuugggaggcugaggcaggagaauggcuugaaccuaggagguggaguuugcagugagccgagaucgugccauuguacuccagcuugggugacagagugagacucugucucaaaaaaaaaaaaaaaaaaaaauuagcugggugugguggcacauaccuguacucccagcuacuuaggaggcugaggugggaggaucauuuggucucuggaggucaaggcugcagugagccaugguugugccacugcacuccagccugggugacagagcaagacccugucucaaaaagugucuuuggacauuccaucucaaccuuaugcacagcuacuuggcagauucccacauaaacguguucugcucgccuuaugcaaagaacuucaugcauaaguuggccugucauccauccucugcucaccacuuugaggaagcccuuccaugucugugagccuccccugccccccuggauagcccuuauucuguuauaaacauucucaccugggaaacucacacagggaacuuuagugugugcacaggaaguaccucaacaucgagcaaguguaguagcuuauauaguccccccagcacaauacaagaaaacccugcaguacauucaggcugauaaguucacaucaaacguacgcucagaccagguugaaucacauuuagcauguugacuuaguuguguuggugacuuucauuaaacaugggaugguucacuaugaauacuuggaacauuucuaaccgaguaguauagucauacugaucugagcaauguuauuguuaauuuucuucuuuuuuucuguuacccuguuuccugaaucuguuuguuaguccuacuuuguucuuuuaguuuuugguuucguuuuguuuuccauuuaagucaacagucaaaaaguguauuucaacugaauucuggcagugaagcagaaaaaagcuguuuaaaaucuguuaauucuugugaaagccacaccuucagggaguuuuugguaacuucuuggaggaguaaaggaaaccuacaacuuugagcagcugcuuaaguuccuugucucuagcucacacuggugcauguacccagcagggcuuaaucauggguccugaugagucuggugggcacacaaggauggaacacugcgguugcagggaaaaugugggaaugucacucuaauugaagacauuuagggccccaaauuggcauugcugaaaagacuguuugaugucagcugugugagccugcacugcuuucucaucuucgauagaaugcaucuucacaguaugugugaaguggcauuaaaguaaccagauuggugccagaggccacuuagaaauuaguuccggugcuuuggaaucacacuuuauuauuuguuuaugauuuggggauuuuauuuuuuguuaaagauacauuucuuugauucuuucguaguucguaagcuggauuauugaguauucacacacgugugugagaugugccacccuugaaccuuguuacaacgugggcacauuauucacuugacauggauuaaaaauaaagauguuucuuuaaaauugcugauugugauuuuugucuuuaauauucuuuuagauuuaauuuuuuuuuuuuuuugagacggagucuugcuaugucgcucaggcuggagugcaauggcgcuaucucagcucacugcaaccuccgccucccagguucaagugauucuccugucucagccuacggaguagcugggauuacaggugcacaucaccaugccuggcuaauuuuuuguauuuuaguagagaugagguuucacuguguugcccaggcuggucucgaacuugaacuccugagcucaggcaauccacccgcccccgccuuccaaggugcuaggauuacaagcaggagccacugcacccagccuguuuuuuuuuuguuguuuuuuguuuuuuuuuugaggcggaaucuugcucugucacccaggcuggagugcaguggcacaaucucggcccauugcaacuucugccuccuggguugaagcgauucuucgauucuucugccucagccucccaaguagcugggaccauaggugcgugccaccacaccuggcuaauuuuuguauuuuuaguagagaugggguuucaccauauuggccaggcuggucucaaacuccuggccucaugauacccccaccucggccucccaaaguguugggauuacaggugugagccaccgcgcuggccuuguuuuuuaagacagggucuugcucuguugcucaggcuggaguacaguggcaugaucauagcucacugcagccuugaaguccugggcucaagccaucuucccaucucagccuccuguacucagacacuguacucuggcacuacaggugugcaccaccaugcccagcuaauuuauuuuuauuuuuguagagauggugggggucucaccauguugccuaugcuggucucgagcuccuggucucaagggauccuccugcccucaagggaucguccugccugggccucccagaguguuggauuauaagcaugagcuaccgcacccggccucuuuaauauucuaaaaucuaaauucauuuuuuuuuuuuuuuuugagauugagucuugcucugucgcccaggcuggaguacaguggcgcgaucucagcuuacugcauccucugccuccuggguucaagugauucucccgucucagucucaugaguaguggcacuacaggcacaugccaccacgcccggcuaguuuuuguauuuuuugguagagaugggguuuugccauguuggccaggcugguuucaaauuccugaccucaagcgaucgaccugucuuggccucccaaagugcuugggauuguaggcgugagccaccguaccuggccuaaaaucaaaauuucuuucuguaacaacccaucucagaaaugccaggauauuauaauuaguaaguaccucagaaaugauuuaguucaaggauuuucuagcuuuuuggucauagcaccccaaaauguuuuugguuauauggguuuauaucuauagauacuaguuuagaaauuaaagcugagaauuuaaaaaauacauuggaguuuuugggauugcuuuuuaaugaauuaaauaagccaauaaguauuaacauaaauaacaucuucugaaaaaugacuuuuucaaaacaaaauaaugaguggcauuguuuuacauuuuugcacaucacuucgugucuguuaauaggagauaguggguuuucaugucuccuuugaauucaguguguugcggaguuuauucagagauccuuuagcugggcaugguggagugugucuguagucccaaauacucaggaagcuaaugcuggaucgcuugagcccaggaguucaagagcagccugggugacauaaugagaccccaucucaaaaaaaaaaaaaaagaaaaaaaaaguucuuugagauauaggaagaaaauuuggccuuucacagguuugaaguuagaaaagagagaaguguuuuuguagccuuuucaguuaauuguggauguucauuugucuuugguacuacagugaaauuuugauaagugauaauuucuuaaaaguuaguuccagugauggaaucugaaacuguaucagugcacuuuggaauacucuugcauuaagacauauuuguguuguucuuugguucuuuaaagugacaggcucguuucauucauuuuugaggaaauagaugccaaguacccaaaucugaauaacuaguuucucagucauucuuucaagucgaaauauguuccagcugcuuugguaucagaagugauucuugcagacuuucuacuuacucacacagaauaugaaaaauuauuggccagaugcaguggcucacuacuguaaucccagcacuuugggaggccgaggaggggguggggcagaucacgaggucaggaguucgagaccagccugaccaacaugguggaaccugugucuacuaaaaauacaaaaauuagccgggcaugguggcaugugccuguagucccagcuacucaggaggcugaggcaggagaaucgcuugaacccgauaggcggaggucgcagugagccgagaucgcgccauugcacuccagccugggcaacagggugaggcucugucucaaaagaaaaagaaaaauuauuguacucaaggccuacaguuuauaaaauuaaaaauuuuuacugcuucaugaaggacagucuuacgugacacuggcuuuuuuuuuuuugagauagagucucacucugucacccaggcuggagugcaguggcacaaucucgauucagugaaaccuccuccucucaagugcaagcaauucuacugccucagcuuccugaguagcugggauuacaggcgcccaccaccacacguggcuaauuuuuguaauuuuagcagagaugggauuucaccauguuggccaggcuggucuugaacuuuugacuucaagugauccgcccuccucggccucccaaagugcugggauuacaggugugagccaccccucccagccgacauuggcuuuuuaaaauccuguuuugguuuuuuauugugagcaugcugcagugagcaauauggugaucacuagugcuguuuggcauuacuaccuugguuuaugcuaaggugcagcaguuucucuccacugcucuugcauugucagugcagaagggagcaaaguugaaaggacaucacauuuuaauguggugcaaagaauuuugaccuugcagacccccuuggagcaaggcucuggaggccucucugucuccccuaguucuguggaccacaguuggagggcuaugaucugguccaucucccauccuauugaagaacccuuucuguaucuuugagaaauuaccuuuccguuucccucagggaugucuauugcgggggaaauucacuacacugugaagcagcccauuacauuuuugaaaguucuguaaacuaggcugggcgcaguggcucacaccuguaaucccagcacuuugggaggccgaggcagguggaucacgaggucaggaguuugagaccagccugaccaacauggugaaaccccgucucuacuaaaaauacaaaaauuagcuggguguuguggugggcgccuguaaucccagcuacucaggagguugagggaggagaaucacuugaacccaggaggcggagguugcagugagccaagaucgugccauugcacuccagccuggguaacagagcgagacuccgucuccaaaaaaaaaaaaaguucuguaaacuaacucagaucucuuuuccacugcuggcccuagauaaaguugaggauaauuuuucacagauuccuugugucucuuuuuuucagcauaaauuuguauuuccauuuccuucagugguuccucucauggccugguuucauauauccugcucaucuuucuuuaaaaugaaaaugaauggacauuauuuaauucauuacaaaagauauugacaaaauaaccauggguucuuuucacuguuagacccuguauaaauauguguaagacuugguucuuauucuaaaggaauuuuaaaaacuggauuuaaacacagcugaagaauauaaacauccugcggaaucauacauggcauuuugcaguuagaaagaacguagcucucggucgggcacgguggcucacgccuguaaucccagcacuuugggaggcggaggcagguggaucacgaggucaggagauugagaccauccuggccaacauggcgaaaccccgucucuacuaaaaauacaaaaauuaucugggcgugguggcacgugccuguaaucccagcugagggaggcugaggcaggagaaucacuugcacccaggagguggggguugcagugagccaagauugugccacugcccucuaaccugggcaacagagugagacucugucucaaaaauaaauaaauaaauaaaaauagaaagaauucguuuugugguucugcagacuggccacugaggugcugugagagcugcucagcugcuuugucgugaauggguuguaguugggcugcaaucucccuucccuaagcuccugggguugcuagguggggcuugggauggccuccuccugauuuuagacugguggauauucccaggccaaucaacucugaccuugaacagcuucuucaguuuacuccaguguguuauacaaagaucguuuucuaugugugccuaugaagaaguugagaaguauuaggaugaguggccucucuagggcaacaaauacuuaggacuagaguugggauuauaaguuuucugaguaccagacuagaaggauaauaaaguuggcaagacauugugauuuaauugaaguagguuaaugaaggacacuuuuuaucauuuuaaaaauuaagaugugaauuuuaguuaccuuuuuaguauucaguucuacaauuuuugacaaacacauauaguguuguaacuauuccaagauauagaacaucaucccccagauucucuuguaccccuuuuuagucagcccuaggcaaccacugacuggaggaaauuguuuuugaagaguauuguaaaauguuuccuuagauggaguuagacauaauuucucccauccaaguacuaaccaggccugaccccacuuaacuuuccacaucagaugagaucgcgugcuuucagggugguauggcccuagaugguaggcauaauuucgaauuaauuggauauuggauucugccaaacaaaaagauuaucaucagaauuuauuucuucuaaaugucugcuuuuaaacuuacugccccacuuucucacuuaagacuucgucacuagcauuugagcauuccaaugauacacauuugaggugauacauuaauugcccuuauuugaucaugacauguugaauauauguugaacuaucacacuguacucccucaauauguacaauuacuaugugucaauuaaaaauaauaaaagcaaaaaaaaaaacuaguuauuucuuucuuuucuuuucuuuuuuguuuuuuugagacggaguuucgcucuuguugcccaggcuggagugcaauggugcaaucucugcucaccacaaccuccgccuccuggguucaagcaauucuugugccucagccucuugaguagcugggauuacaggcaugugccaccaugccuggcuaauuuuguauuuuuaguagagacaggguuucuccauguuggucaggcuggucucgaacucccgauaucaggugaucugcccuccuugcccucccaaaguguugggauuacaggcgugagccacugugcccggcuauacuaguuauuucuaaauacauuugaaguaaaaguuguucuugagcauuacuggugcuuuggaaguguuugugaaggggcuuugggaaacagaaagcccuggcagauucuacagggacugaccuguuccugcugucuuacuguagaucuggagcagcaaccauuuguuccccagugcagagaaagcgacucuuuuccucggcacacuggauaccauuuuccucuucuccuaugcugugguaaguuuuggaacucuagggcuuaaagcuaaagaaaaauguaaauauaaaugacccugagccuuacaaaauuuguaagggauuuugaauuugcugacugaggcagaguucaguauuucugaaguuuauauuguuuguucuucccauucauuuauucauucauucgacagauauuuauugcucaucuagcauaugucaaugggaauuuaucccgaacaacacaaaaugcccugccuuuauggaccuguauucuuggaguuaggggagacagacaguaaccaaaugcuacaaauaaauuauagaguauauuugaaggugguaaguacaacggaggaaaauaaagcagagaagggggacuaaaggggccugggugagguuguaauuuuaaguagcacagccgggagaccucaggaggcagcgggcauuugagugaagaccugagcaggugagcgagucggugugcuuggaucagagcugcaagaagagaggccagagaugcgguggggcucagaucuguaggguuuugguaccuuuggggcggcuuuggcuuuaaccuugagugagaugggagcugcuggaagguuuugugcagagcagcggcaggaccugacuuagguuuggauaggugcacuugcucugggagccgaguucuuuugaggugaaggaugauggugacuuggguccagcgcaacaguaauagagguuggggggaaguagauuuuagcgguguuuuggagguaaagccaauaauauuuuuucccucuugaauguggaauguaagagaaaugugucaagaacaccuccaggguggaagugucauggcagaggggagacuggggagauagaaagcuuugaugacucgcuuuuggaugcauuacauuugaccucugcugcccagaugaugaagagcagacacuuggucauugaguguggaguucaagguguagguucagucugaagauacauguuuuuggaguccuuggccuuuauuauuauuauuauguuuuuaauuuuuuauuuuugagacagaguuuugcacuugucgcccaggcuggagugcaauggcacaaucuuggcucaccacaaccuccaccucucggguucaagcaauucuccugccucagccuccugaguagcugggauugcaggcaugcgccaccacgcccggcuaauuuuguguuuuuuuaguagagaccgaguuucuccauguuggucaggcugaucuggaacacccaaccucagacgauccgcuugccucggccucccaaagugcugggauuacaggcgugagccacugcgcucggaguccuuggccuuuagaugauuuauagaucaaaacugugaggcugcgugaauugaucaagagaacaggcgagggcggggaagaggugugaaaccugagcccuagggcuuccaguccucagaggugggugaggaaugggccagguagcggggguggagugguaagaaagguggggcugggcgcgguggcccacgccuguaauccuagcacuuugggagaccgaggcagguggauaacuuggggucaggaguuugagaccauccuggccagcaugaagaaaccccauuuccaauaaaaauacaaaaauuagccagaugugggugccuguagucccagcuacuugggaggcugaggcagaagaauugcuugaacccgggaggaggagguugcagugagccgagauugcgucacugcacuccagccuggaugacaaaaugagacuccaucucaaaaaaaaaaaaaaaaaggaaggugggauccuggagagguagcacccugggagacauuccacgguggcgaggaguaauucagcgucaggauaggcagcuggcgucucugucuggcuguaggaacagcugugguggaugccacauuagaguucuggagcugaugguggcagcagcuggaacguggacugugagaggagccuuccuuuucuccccagcauauaagaugcugucuuuaaguaugccuuauuucugucuuuaagugugccuuauuaaaaacgccuuuuaauucucaauguccaggcaaugugaaauacuggguaaaaguucugaaguaguuucuaaauguuuauuugguuaguuauuuuuauuuauuuauuuaauuuuauuguauuauuauuuuuugagacggagucuugcucucuugcccaggcuggagugcaauggugcuaucucagcucacugcaaccuccgccuccuaguuccagugauucuccugccucagcuuccuggguagcugggauuacaggugcacaccaucaugcccagcuaauguuuguauuuuuaguagagaugggguuucaucguguuggccaggcuggucucaaacuccuguccucaguugauccacuuaccgcugccuuccaaagugcugggauuacaggcguuagcuaccaugccuggccuauuuuuuuuuuuauuugagauggagucuugcuguguugcccaggcuggagugcaguggcacaaucuuggcucacugcaaccucugcccccuggguucaagcaauucugcugcuucagccuccugaguagcugggacugcagacaugugccaccaugcccugcuaauuuuuuuuguauuuuuaguagagaugggguuucaccguguuggucagacuggucucaaacuccugaccucaaaugauccgcccaccucggccuuccaaagugcugggauuacaggugugagccacugcgcccagccuauuugguuaauuauuaagaguaucuuuucuucaaagaggaaacagagaaacaguuggaacaguucuuuggucauucauuuagucuaccuccucaccuuggguauuuucuguauaaaauccccauguagaggcacggggcuuuggcuggagcuggugacagggugcucgcuucucuucgagccacucauuucuuucagggaccaguuuaagaggcaguguagucuaacuagcuguguuaaacuugguugcgaaguagaauuuaaccuuuuuuugguguuuaguuuccucaucuauggagucaucuauaggacuagauuuaggacauaaaggaucaaugccaugaaaaaucaauggucaugguuuuuuuuuuaucuugagcugcacuuccuucuguaacuuaugggcauuuugcuuucugcagcaaaacagaauguauugauucugguggggcacgguggcucacgccuguaaucccaguacuuugggaggccaaggagggcagaucaccugaggucaggaguuugagaccagccuggccaacauggcagaaccccaucucuacugaaaauacaaaaauuagccaggcaaauucaguuaggaccagguguuucuaauaaauugacuuaucucuaaaacuuggcugggcguggugucugacgccuauaauccuagcacuuugggaguggggagaauugcuugaggccaauacuucaagaccaaacuggccaacauagcaagaacccaucucuaaaaaaacaaaaauuggcaggccuguagucccagcuacucgggaggcuacggcaggagaauugcucgaaccuaggagacagaggcugcagugagccaagaucacaucauugcauuccagccuggaugacagagugagacucugucucaaaaaaaaaaaaaaaaaaaaaaaaaaaaaaaaaaaagcauguauuguucugucaucugaagcagaauugagauuuucuucaucccuuuuguucuguguagcauaaguccauaugaggggcagcuagacaacauagaaucuacuuuaaggcugacaugcuucucuuaagaugaggaagcuugaugauaaugagggagaaacguucauauuuaaauuuaucuucucauuuuuuuuuugagauggagucccacucuaucgcccaggcuggagugcaguggugccaucucggcugacugcaagccccgcuuccuggguucaagugauucuccugccucagccucccaaguuucugggauuacaggcgcaagccaccaugccuggcuaauuuuucuguuuuuaguagagacaggguuucaccauguuggucaggcuggucuugaacucuucaccucaggugauccaccugccuuggccucccaaagugcugggauuacaggugugagcuacugcacucggccaauuuuuuuuuuuuuagagauggguucuugcuauguuggccaguuuggucuugaacuauuggccucaagcaauucuccccgcucccaaagugcuaggauuacaggcgugagacaccacgcccagccaaguuuuagagauagucaauuuauuagaaacaccugguccuaacugaauuuagguuuucagucaagauauuuuauauauuuauggaagaaaccuaaagugugcugcgcuuaaggucuucagucucacuuccugccaugaucucagcauuuuaauuccugccacucagugggaggagagcagaaggcagaaccugucuccagcuaauuauugucucugccuuccuacucucccugccuugggaugucaugaaacccaagggucagauucaacaggcagcuagugugcccuggaaccuucuauuccacuuuuuacaagguuggaacugaaacugcagggcgugugguaacacguuaacccagagugcagauggcuaagaggaaucccuuugggauagcuuaucacugauggguaggaauuaaucuagucuagaaaaugaaguauauuugugugcuuguuuuauuagagucauucuuauuuauuuauuuuuuuccaguuagggaaucaaguaaaaccaaaguuugcccugaacuuugguguguuugugguagagugugcccgcugccauuucuuuuuuuuuuuaauauuuuuuuccuucuauuuucauaacuuuuuuguuuucacuguauuacugaccauguuauccagcccacugccauuucaugaaacauuugugaaacuccuguagacagguagccucggcauguguauaagaguuaauuuuaaauaauaucuguguuugucucauuugcuuugcagugcauguuacuuuuucauacuguguuauuauuuagagcuguaaaagaaaaugcuuuauuuuuagggccuauucaucaguggcaucguuggggaucgguugaauuugcgauggguucugucuuuuggcaugugcucuucugcauuagugguaaguugaaaggucuuauuauuauuauuuuggucagguauuuuagaaucuaaguaaucucccuacuucucuguagaauagaauaguaagauuaauccucauuguucgaaucccucauuugccuuuucacuuagaugagucuuuuuuuucccccccgagacagaaucuugcucuauuaccccaggcuggagugcaguggugcgaucucagcucacugcaaccucugccucccauguucaagcgauucugcugccucagccuccugagcagcugggacuauagguacagcucaccacgccugggugauuuuuguauuuuugguagagacgggguuucaccauguuggccagucuuaucuccuggccucaggugauccuccugccuuggccucccaaagugcugggauuacaggcaugagccacugcgccuggccagaugagucuuuuuaaaguaagauucuaaucagguuccuuuguugucccucaggcaccagcagaguuaauuaauagucugaauaaauggccuggcauucacuacacccuggccccagccugccuucccaucauauuugucacucugcuucaucgcuuugcuccagccaagcuggacugcuuuccaggccgcuaacaucccgcuccuuucuuuuuuuuuuuuuuuuuuuuuuuuugaggcggaguuuugcucuuuuuuuuuuauuuuuuuauuuauuuuuuuuuuauugaucauucuuggguguuucucgcagagggggauuuggcagggucauaggacaauaguggagggaaggucagcagauaaacaagugaacaaaggucucugguuuuccuaggcagaggacccugcggccuuccgaaguguuugugucccuggguacuuaagauuagggaguggugaugacucuuaacgagccugcugccuucaagcaucuguuuaacaaagcacaucuugcaccgcccuuaauccauuuaacccugaguggacacagcacauguuucagagagcacaggguuggggauaaggucacagaucaacaggaucccaaggcagaagaauuuuucuuaguacagaacaaaaugaaaagucucccaugucuacuucuauccacacaaacccggcaaccauccgauuucucaauuuuuuccccacccuucccgccuuucuauuccacaaaaccgccauugucaucauggcccauccccaaugagccgcugggcacaccucccagacggggucguggccgggcagaggggcuccucacuucccaguaggggcggccgggcagaagcgccccucaccucccggauggggcggcuggccgggcggggggcugaccccccccaccacccucccugacggggcggcuggccgggcagagggguccucacuucccauuaggggcggccgggcagaggcgccccucaccucccggccggggcggccggcugggcggggggcugaccccgccaccucccucccggacagggcggcuggccgacccccccccccgccucccucccggacggggcggcuggccgggcagaggggcuccucgcuucccaguaggggcggccgggcagaggcgccccucaccuccgggacggggcggcuggccaggcggggggcugauccccccaccucccucccggacggggcggcuggccggguggggggcugaccccccaccucccucccggacugggcggcuggccgggcagggggcugacccccccccccaccucccucccggacggggcggcuggccgggcagagggguccucacuucccaguaggggcagccgggcagaggcgccccucaccucccggacggggcggcuggccgggcggggggcugaccccccaccucccucccggacggggcggcuggccgggcagagggguccucacuucccgguaggggcggccgggcagaggcgccccucaccucccagacggggcggcuggccgggcggggggcugacccccccccccaccucccucccggacggggcggcugccgggcggagacgcuccucacuucccagacgggguggcugccggacggaggggcuccucacuucucagacggggcgguugccaggcagaggguuuccucacuucucagacggggcggccgggcagagacgcuccucaccucccagacaggguugcggcccagcagaggcgcuccucacaucccagacagggcggcggggcagaggcgcuccccacaucucagacaaugggcggcggggaagaggcgcuccucgcuuccuagaugggauggcggccgggaagaggcgcuccucacuuccuagaugggaugguggccgggcagagacgcuccucacuuuccagacugggcagccaggcagagaggcuccucauaucccagacgauggggggccaggcagagacgcuccucacuucccagacaggguggcggcugggcagaggcugcaaucucggcacuuuggggggccaaggcaggcagcugggagguggagguuguagcgagccgagaucacgccacugcacuccagccugggcaccauugagcacugagugaacgagacuccgucugcaaucccggcaccucgggaggccgaggcuggcggaucacucgcgguuaggagcuggagaccagcccggccgacacagcaaaaccccgucuccaccaaaaaaaaaacgaaaaccagucaggcguggcggcgcgcgccugcaaucgcaggcacucggcaggcugaggcaggagaaucaggcagggagguugcagugagccgagauggcagcaguaccguccagcuuuggcucggcaucagagggagaccguggaaggagaccguggagagagagggagacggagagggagagagggagggggagggggagggggagggggagggggagggggagggagaggcuguguguccggaguuuugcucuuguugcccaggcuggaguggaauggcacaaucuuggcucaccacaaccuccaccucccagguucaagcgauucucaugccucagccuccugaguagcugggauuacaagcaugcaccaccacaccugacuaacuuuuuuauuuuuaguaaagacggguuucuccauguuggucaggcuggucucgaacucccgaccucaggugauccgcccaccucggccucccaaagugcugggauuacaggugugagccaccgcaccuggcccuauccugcuccuuucuaucucggugcuuuuguuucuccuguucugccugccuuggaugguccccuuuucagcucuccauagucuaacucacagucuccuucaagcauuggccaaaugacaccucuuugagaaugucagucccgcuucugagcugcagugccuguuucuuugcaggcacuugaaacagucugccgcuuagcuugguuauuucugguucagucuugcuuucccuuaggguggguaugcagugguuaaaaucacagauucccuagacaaggacagccuggguuucugucugucuucugugguuuucuagcuuaugauuucugugagcuucagagggagaugggcauauuagcucuccccggguggcagugaggacugugaguuucuguaugugaggcauuugaaacaagugcuguguaggggaggauccauaucugauuaaucuuuuuuuuuuuuuuuuuaaacggagucuugcucugucacccaagcuggagugcaguggcaugaucuuggcucacugcaaccuccacuucccagauucaagccauucuccuguuuuagccuccugaguagcugggacuacaggugugcaccaccauucccggcuaauuuuuguauuuuuaguagagucaggguuucaccauguuggccaggcuagucuugaacuccugaccucaggugaucugcccaccccagccucccaaagugcugggauuacaggggugagccaccgugcccagccuccauaucugacuaaucgucauugcuuacuagcuucuagucaggaauuuuuguugauuaaaugaaaccauggaguuuaguuagacccuaauuuauuaugauuauuauuuuuuuagagauaaggucucgauuugcugcccaggcuggagugcagcggugugauccugcagccuugaacucccaagcucgagcaauccucccauuuuagccucccguguagcugggacuguagguguguaccaucaugcuuagcuaauuuuuaaauuuuuuagucauggggucucacuauauugcccagguuguuccuugaacuccuggccuuaagugauccucccuccuuugccuccgcaaacacuggaauuaccggcacaagucccugcguuuggccuacuauuguuuuucaguguuugucauuugaguguaaguaaaaccuuuuuuccccuugacauuuuagagauggaagcacuuuauuuauuuaugaguugcucacccacacauaauaaacauauuauuuuaaaaccuguguacagacuuuuuuguguuuuauguauuuuuuaaaaacugcaguuuguacauaaacuugcccuuuuuaagcauauuguucagacuuuucaacaaaugaguaguuuugugaccgccccuucuuucuccagccccuggcaaccccugaucauuuuucuguguacaguuuuacuuauuccagaaugucuuguaacuggaacuagacaguauuauacauacuauuuuuuaaucaugcagaguauucucagaauagaguuugacuguagauaaaauguccacuugagcaaaaugccuggaaaaaagcagccccuugaugaaagcugcuaaaugauucagcagaucacaaguuugauagguuucgcuuucguugauuaacucaggagcuguagccauaacaguggcuggcaugcgccccgugccucugcccauagcagcaccuggcacugcuccgggaaagguggccucccugggcucguucuguccucacagcagcccucuggagguugcuguucccuccacaugcacagucugagggugaggagauggaaauacauguaaaaugaggaauuacuuuuuuuuuuuuuuuuugagacagagucucgcacucccgcgcaggcuggagugcaguggcacgaucuuggcucacugcaagcuccaccucccagguucaugccauucuccugccucagccuccugaguagcugggacuacaggcaccugccaccacgccuagcuaauuuuuuauaauuucauuagagacgggguuucaccguguuagccaggauggucucgauuuccugaccuugugaucugcccuccucggccucccaaagugcugagauuacaggcgugagcccggccuggaauucacuuuuuagccuugaagaugucaguuggagggcugauagcuuaaugacuuuaugucuuuggcaucuccuccucucuggugggcagugauuggguggcugccuccucacuguggcucugagcaggaccuuugugaugcuggccacgugacuuacaggcacuggcugugugaguguauccuucacguggucucuacucugaagcaaguggguagaguggcguccacugaaagugucaguguggcuguuacauauuccuuuuguuuccuccucuucaagguguuugucuuuggugcgcucacagaauggcugcguuucuacaacaaauggcuguacugcugccuguggauugugaacggccugcugcaguccacugguuggcccugugugguugcuguuaugggcaacugguuugggaaagccggguaugccacuuccuuccucucuaauuucucuguuuaagugguuuccaugguggauuuuucagacuugucaaagucaguuacuuugcugccuuagauaccacccacaucuuucguuagcaagucagaguuguucagggagagaggguuucacgucagugugcguuggaaaugguguggaccuuagaagucauccagccuaggagacacacuccuaccacucuuugggcugugggcagauucugagugugggccaaggcaggaggucucaauuuuuuauuuuacucaucguuucuuuauagaacauaaaaaucucauuuacuauccaucauguaucuuccuuuggguuuugccuucccugcccuuuuuugagagugaucuuauuuaaccuuuuuacauuaaagauaaggaaauuaaggucaaagguuauucauguugaccugcccaaggucauguaacaagggcucuaauuagacucagaugaagaacgccagacuuuggggcuugaucaaaugggguauuuuuucccucuaaaccuucaaggagcuuuuuuuucuuuuuuguuuuugagacagagucuugcucugucaccaggcuggagugcaguggggugaucucggcucacugcaaccuucgccuccgggguucaagugauucuccugccucagccucccaaguagcugggauuacagguguguaccaccauguccagcuaauuuuuuuuuuuuuuuugagauggaguuuugcucuuguugcccauugcaauggcgcgaucucggcucacugcaaccuccgccucccagguucaagcgauucuccugcuguagccuccugaguagcugggauuacaggcaugugcccccacaccuggcuaguuuugcauuuuuaguacagaugggguuucuccauguuggucaggcuggucucgaucuccugaccucaggugauuucgcccgccucagccuuccaaagugcugggauuacaggcaugagccaccgcacccagccauaauuuuauauauaaauggaaucauacaguauguacucuuuuuuugagucaucuuuuuuuuuuuuuuuuccuguagagaaagggucuguguugcccaggcuggucucaauuucauggccucaagcuauucugccucggccucccgaagugcugggaauauaggcaugagccaccacacccagccuuugugucuucuuucauucagcauaauuauaaauuuauucauguuuauucauucaccuguggaugaacauuuggguuguuuucaguuuugggcgguuacaaauaaagcuccugggaacauuuguguacaaauccuuguguggacauaugcuuucauuucucuuggguaaauaucuagggguagaauggcuggaucauaugcuagguuuguauuucccuuuuuuuuguuuuuccccaggacagaguuucgcucuuacugcccaggcuggagugcaauggcgugaucucggcucaccucagccuccaccuccuggguucaagcaauucuccuuccucagccucccgaguagcugggauuacaggggcccgccaccaugcccagcuaauuuuuuguauuuuuaguggagaugggguuucuccauguuggccaggcuggucuugaacuccugaccucaggugauccacccaccuuggccucccaaagugcugggacuauaggcguagcuacugcgccuggcugcguuuaccauuuuaagacacuggcagucucuuccaagguggucguaccauuuuacauucccaucagcagagcauaaggguucuuauugcucugugcccuucccaacacuuggcgugcuugguguuuuuugauuuuagccauucuaauagguguguaaugauaucgcauugugacuuuaauuuccauuuuucuaauaucuaaugacguugagcaucuuuuuaaaaacauuuuugcuuuguuuugcuuuugaaacagggucucgcccugucacccaggcuggaguauaguggugcgaucucggcucacugcaaccuccgccuccugguuucaagugauucucuugccucagccucccaaguagcugggauuauaggugugcagccaccaugugcagcuaauuuuuguauuuuuaguagagacgggguuucgccguguuggucaggcuagucucaaacuccugaccucaagugaccugcccaccucaggccucccaaaggcugagauuacaggcgugagcccucgccuggccacuugaguguuuuuucgugugcuucuuuguauauuuuuuugugugaaguaucuauuaaaaucuuuugcccacuuuucaaagacuuuguauuuugagaugauuguagauucaugcuuuuuaacauacuauugcauugucuguugucauauuuuacugaguuuugagggccuuauauucuggauuuuuuuguuuuguuuuuuuuuuuugggagguggagucucgcuuuguugucaaggcuggagugcaguggcgugaucucggcuuacugcaaccucugccucauggguucaagcuauucucuugccucagucuuccgaguagcugggauuacaggcgccugccaccacgcccaacugauuuuguauuuuuaguagagaugggguuucuccauguuggucaggcuggucucgaacuccugaccucaggugaucuguccgccuuggccucccaaaguacugggauuacaggugugagccacugcgcccagcccauuuuaguguauuuuuaaaaacuuuuuaaauagcauguuuagucuugguaguaugcaccuugguuguuuuggcuguuuuguauuuugaacugcccagaguaucucuucugaccauggcccuuugucucccacuguuuuccaucuuagacgaggaguuguuuuuggucucuggagugccugugcuucggugggcaacauuuugggagcgugccuagcuucuucuguucuucaguaugguuaugagguagguauuguuuucuagcucuggugcucucucucucucucugugugcacauguguauugcuuuuuauguauuaaauaauacuguggccauuuaaaacuauguagaacugugucuggauagggcaaggcuuguauuaaaaguagacaaacuucuggccgggugugguggcucacgccuauaaccccagcacuuugggaggccaaggcaggcggaucagccgaggucgggaguuugagaccaguuuggccaacauggugaaaccucgucucuacucaaaaaauacaaaaauuagcugggugugguggcgcaugccuauaaucccagcuacucuggaggcugaggcaggagaaucguuugaacccacgaggcggagguugcagugagccaaggucgcaccgcuucacuccagccugggugacagagugagacucuguucagaaauaaauuaauuaaaaaaaaaaaaguagacaaacuucugauauauucauuaaaaguagauaaacuucugauauauucaaacacauaaaaaauuauucguaacaaaaacacuauggagagucuaaagacauauaaccaguugagaaguauuugcaacucauguuacagauaaaggacuaaucugggucaggcaugguggcucacgccuguaaucccagcacuuugggaggcugaaguagaaggaucacuugagcccaggaguucaagaucagccugggcaauauaaugagaccuuguaccuacaaaaaaacuaaaaaauuagcugaguguggggguguaugccuauagucucugcuauucaggaggcugaggugggaggauugauugcuugagccugggagcuggaggguacagugagccaagauacaccacugcacuccaaucuuggugauggagcaagacccugucucaaaaaaaaaaaaaaaaaacaccaaaaagcaaagacuaauccccccuaauauguaaagagcauccaugaauugauaagaaaaagaccaacaacagaaagauacagaauuugaauguauagcucauguaaagcauguaggaauggcuuguaaacauauguaaaauauucuacucacugcuuauucauuuaauaaauauuuaacucccuguauaugcucuuggaacuauagaauauagaacugaccaacagggacaaaaaucucuguucuuauggaacuuagcagggaaaugcaaauuaaagcuauguuguuuaaaaaaaaaaaaggaagaaaaacuauacuguauacuuauuagacuaaaaauccaaaaguuugaaaacauguuguacuuuuaagaaccugaagagacaggcauugcaguugaaagacuaacagagucacuaacucauggaggggucaauauggaagugucugucaaaauuacaacuacgcacacugaguaguuccaccuccaggaauuauucacacagaugaauagacuaaaacacaugcaaaugaugcaucuacaagauucuuuauuuuggcauuguuuauaauagccaaagagugaacacaacugucagcgaacagggacauaguucaaccaugauaaaccuguugaaagcaaugcugugcaccugugaagucgaaugaggaagcucuguaugaacugauagcagugcacugcagcaaucucaaaagugugcuaagugggccaggugugguggcucacgccuguaaucccagcacuuugggaggcugaggcagguggaucacgaggucaggaguucaagaccagccuggccaacaugaugaaacccugucucuacuaaaaauacaaaaauuagccgggcguggucacgggcaccuguaaucccagcuacuccagaggcugaggcagagaauugcuugaauccaagaggcggagguugcagugagccaagaucaugccauugcacuccagccugagugacaaagcgagacuccguaucaaaaaaaaaacaaaacaaaacagugugcuaagugaagacagcaagggugcaaaacuguguauugaaugccauuuauguaagaaggaagaaugaaagagaauaugcuuguauuagcuuguauguuuccaaaacaauuucugggcaguaaaaaugaacaacaaugguuauauguugggaaaaucgggagaauugagcagauggggaaggugggguaggaaggagaguuuuuacuguacuuucuuuuuuuuuuuuccaagacagagucucacucugucaccuaggcuggagugcaauggcgugaucucagcucaccgcaaccuccuggguucaggagauucuccugccucagccucccgaguagcugggauuacagguguacgccaccacgccuggguaauuuuuguauuuuuaguagagaugggguuucaccauguuggccaggcuagucuugaacuccugaccucaggugauccgcccaccucggccucccaaagugcugggauuauagguaugagccaccgugcccagcuugacuguaccucuuauuccucuguugcuugaaucaugugaauauauuaccuacucaaaaaccuaaauuauuaaagguaaguucgcucuuuuaaaagguagauacauuuuuaaacagcucaccaagaauuuugguguaguuagggucagugagaaguccuucauucccuucauucauggccaccuuuauucuaggcuucuuagccucacaccuggauuguauaguugguucagaugaaaauuucaguucaccuucugagcugcucucagauuugacuucuggaaacacuaauuuugucacucaucgguuuaaaaauucaguguccacaucagguuccauucucuguuaaauaaaaauucagcugugcagccuggggguugagagucuuuaaucuagcugucaccuuuccaaaucaguuuucuuccugauuauccccuagcagaagcccucuccuugagucgugcaguaagcuuucuaucuccuuccacccugugucuuugcuuaccgugugccuggaaagaugggcaauugacuuugauuuuccauucuucccuaagacauugucuuacugcuucaaccucuucagcucuuuccuucaucuggauucccguauauguuucucaguaggauugggccuucucaucuauucagcuucuuggugcuuuauaauauuguuucauguauuuaauccccucaacuguauguaauaucuuugagggcagauacugucuuuuaugagaggcuaugugauacaaagaccuagauuuuuggagcuagucuaauuucacaaucauaacaguaccacuuaguauccaggggagcuucauucuccucucugagccucauacaaucaccaggaagaauuaaaugagaaaacacgaguagaacacuuugcauggcgcccggcccaguagaagcucugggugcucccuugcuucccggucucccuucccaccucucccccacccccaccuucccccacacaccuuuaaugaaugugcuugugaugacuguccccagauauguaaggaccaccuuucaccccucuccuccaguaugccuuucuggugacggcgucugugcaguuugcuggugggaucguuaucuucuuuggacuccuggugucaccagaagaaauuggugaggagaagccgccccuucuauuccgaaugucuuacuauuauggccgaaaggaaaucugaggccaagaaaucgaaucucuuuuuuccuaggaaaacucugagcuccuuuuagugagugaaaggagaacaguacugccguuugaguccugucgacauuguagccagccccuggcacagcuggacguguuugaggggagugaugcacgucuuuuauagauacaggaaaaucuucgcauuugcaaauuauuuuuauaauugagacacuggcaaggaaugaacauagauguauuucugauuucacuucuugaaacauuucuuuucauccauaaaaaugaugcacaaaaaagauacuuaaccuguaguuaaauacagauuacauacaaaugaaaccacagaagcaaacagauguacaauucuucuaucuuuugaguauuuuuagauagacugugugacuuuaauugaccuuaguugaccucggucucuggaccuucguugcugcuucuguaaaauggaaauaaaaauaacaucaccucauaaguagggauguaugcagagcccuucacacgugguaggcacuccauaaacaguggcugucgcuguuauuuuaggucucucggguauugaggcagaagaaaacuuugaagaagacucacacaggccauuaauuaaugguggugaaaaugaagacgaauaugagccgaauuauucaauccaagaugauaguucuguugcccaagucaaggcgauaagcuucuaccaggcauguugccuuccuggagucauaccgguaaggaccgcuuacaucuuaccacagccagggagguaugagagcccgugacaucuccucugccugagauaaagcuuccuuaaguauugagccucuguuggauacuuuauuuuaggaauauacgugcugaggaauguugucuagugccccucagcuuaucugaucucuaaugcagggguugacaaaccuuuuccaugaagaggcagagaauaaauauuuuugacuucggggaaccauccagucucucccccaacuacucagcuuuguagaacaaaauaagccacagaaaacaugggacaguuagacguggccagacuuggccaaagagcucugcuuuccugacccugaucugguaugugauuaaaaaggcaaaauugauaauuuuuaaugugugcuuuugggccuuucgaaguauuauagaauuauauguggaccaagaagaaggguugugaaugguuccuaagucugccuugcccccuuuuauuuuuuauuuauuuauuuaugauuuugggacggagugucgcucugucacccaggcuggagugcaguggcgcagucucggcucacugcaaccucugccucccggguucaagcgauucuccugccucagccucccgaguagcugggauuacaggugcaugccaccaugcuuggcuaauuuuuuguauuuuuaguagagacaggguuucacuguguuagccgggauggucuccaucucuugaucucauggucugcccacuuuggccucccagaaugcugggauuacaggcgugagccaccgcgccuggcuugcccccuuuuaaaggguccagaagagagcacuccacagucuuucuugguaaugcauuccaguguuuuccacagccugugcagucaggaaagccuucuaacgucuacacuaaaucccuucugcugcaguuuuucugucuugauguuucgggcacucuagcacuggaguggaaguuaagaggccuagguuauguuuccagcuuacccacuaacuuucugugacaccuggggugagucacgcaacccguccgugugucucaguuccccuucccauggaauagaaauuauuccacucuucccuggggccuguaacauugggcuguuguguuuugaacaagcaccuguuguuauuucauuugucaauggugcuuuaugaaugugaucccucagguagagugaucuguaggccaucuuaauacaugccugucaauccccuucugucagugccuccaagcugagagaacuaacauuuccaacaaaguuaaguaugaauuaaaauguaauuuuccacaauucuuuaacccagugaugauauaugauauaagagaaaugcagguugcuuuagaccuguucuuaugcuauugauuauuaucuuuuaacugguuuuuaaaguacucugcugguaauaguuuaauuuuugagaaagaacuuugucgugacuaaauauggaccucuuuugcuguuccuuuguucuucacaagcuauuguucucugacaugggcagggauguaaaggaaaucuaguuaacuuaauuccuuugucuuuguagcaggcugucuggucagaaugcacucgugauugggauuuggcucucuaggggguggcuguugccugccagggaagcuguuuuaaaacaagugauaccuagggaauaacuggcagcuccagggaaaagaauauacuagccagacacccuuugaagucagccccucuguccccccccccuuuuuccuuugaugcugaaugucaggauuuccugguaguaauguguugaauauaggagucucagccccaccaccaucuucaugcagcugcagcauuuuuuuccccucaagggagagccacgaggccgaugaugacauguucuuucauuuuugacucgccagagagacucucuucuuugccaccagaccagggaauguggagcuuuugaaaacuagugugaaaggaauuaucaugcugcugcuuuucuuagaccguggaacuguaguguagucccuuugcuguccauuguucacaguguugccuuggcaaggaguagaauaaccaaccccguuuggcugcucccaguaaaggccgugaugcuuccuggacuucuuugccuaugguuaacgcugguuaguggcaugaauaccauuccucuuugugugaauaaagaaauauggguaugugcucugccuuauagguucaaaacacuggcuugcuucuaccagagaacugauaggaggagaaacuggacacagcuaagaaguagccauagguguuuuuuauuccaaaggccugcuguacaugccugucuagaaguuaacagggaugaagagcagagggagacuagcugaagucaggcaugugggaguuuguagagauguuuaacuguaaaaucagguucuguucauccuaacuuccuuuauuuuguuuugcuuuuaaaugacauuaaaaaugguagucgugcugugcuauuugucccucgcugauaguugaaugcuuuucuuguaguacucacuggccuacgccugcuugaaguuagugaauuacuccuucuucuucuggcuccccuuuuaucugaguaacaacuucggcuggaaggaggcggaagccgacaagcuguccauuugguacgacguuggagggaucauagguaugccggugauacaucuuuuccauaauaaagaguuagucacuagugaucuuuuacuggguugugaaaucuggccucauuuaaaguuuuauuacuuauucuacagccauuuucccuaaacuguccuacuaguaaacagccaaacucaaaaaaaaaaaaaaaagaaaagaaaagaaaagaaaaaacaagagguccauagaaaggaagaccuagccuaaggcagcgcugugauuuauuggacucuuuuuucuuaguccuuuguugauggaucaguucuuuugucucgggaagcacaugggaaucucuuuaaaugcaauccuuucauacggcuuucucagugauaucuuagcucuaaagcuaauuguaugucagagauccaaguuagaauaugaacguguucauuguaucuaccucccaccuuccccaccuuccccagccuaauaaggaagaauacaccagucccccacuuaucugugguuucacuuuucgaaguuucaguuacucuuaauaccguacaauaagauauuuucagagagaccauucauauaacuuauguuacaguauauuguuauuauuuucuauuuugucguuauuguuaauuucugugcccaacuuauaaauuaaacuugaucguggguauguauguauagaaaaaaacauaguauguauagaguuugguacugucugugguuucagguauccacgggggucauggaacauaucugcugaggauaaaggggaaauacaccuuaguguguaggucgucagaucauagagguagacguaacagcagggauuaauuuuugugaauguuuuacaguuguuucauuauaaacaaagauuuuaauagugguuuuuuuuuuuuuugcuguagcuagaaguaucaacaaggagguaauaaguaugaacaaggaaguaaggcagaggagcagaauguauuuuaguggguauuacuuacauggcugugccagaucuuaauaaccuucaauaauguuaacauuuagaauuguggugagacucaacugccgugagcuugugaaagcacacagucugugcuaggcaaucugcuauuacuguauuugaacuuggcugcccguauucuuaaauccagagccaaaggugagguugccaccguuagaccucaccauauucuguauccucugaaguugaaauuguccagcugccugcuaucugauaaggacacaccagauguccaauagccccuacaacucagaauggugcuguaugugacauuguugcuugaaagauucauaucccugcuuuuuaaagauuguguccuauuagcaaaccauaacugcuaaauuuuauuuuagugaauauuuacuagccacuuuuuuuuuucuuuuuuuuuuuuuuuggagauggggguacugcucugucgcccacgcuggaguggcacgaucuuggcucacuggagccacaaccuccugggcucaagcgauccucccuaaguaccuggggcuacagucaugcaccaccacacccagcuaauuuuuuuguauuuuuuguagagauggcauuucacuguauugcccaggcuggucucaaacuccugagcucaggcaauuugcccaccucggccucccagagugcugggauuacaggcgugagccacugugcccaccuacuggccucaauauacuguaaggcacaguuuuuuugguuuuugagacacggucuugcucuguugcccaggcuagagugcaguggcacaauacagcucacuguagccucagccuccuggguucaagcagcacgauacgguucaccacagccucaaccuccugggcucaagccauccuccuaccucagccucccaaguagcugggaauauaggcacgugcuaccaugcccggcuaauuuaucuuuuauagagauaagggcacuguguugcccaggcugguuuugaaccccuggccucaagcagucccccagccuuggucucccaaagugcugggauuauaggcaugagccaccaugcccagcaaggcauaguucuuaauucauuaucuuucaaauuaaaaagaaaaaucaaaaauagcauucacaacuuguuuuuguaagggauagccgauggcuuugacaguuuuuccuuuuuucauguuuugcugucugauuuguggucuccuguccccacuggucaucauggugauuuaacagacaguuuauuccuaaaaggaaguuauggaggaccccuuuucagggagucagaccuauuuuuuuuugagacagagucucgcucugucacccaggcuggagugcaguggcgcaaucucggcucacugcaagcuccgccucccagguucacaccauucuccugccucagccuccugaguagcugggacuacaggugcccgccaccacgcccggcuaauuuuuuuguauuuuuaguagagacaggguuucacuguguuagccaggauggucuccaucuccugaccuugugauccaccugccucagccucccaaagagcugggauuacaggugugagccaccgagcccggcccagccauauuuuuugauagacuagugucaggcugcugcuagugagacuagagggcaaauggggagcacgccucaggugagcgagcuaaauuagaagugauuuugauugcucgacacucugcuugaagguggaacuuugcaaggcuucaucucugauguacuacagaagagagcgccgguucuugcccugagucugcuucuggcaguugggucccucaucggguauagucgugaguauucuuuugcaauuacuaauuccuuugcuccccuaaucugguuggaauaaggcauuuguuuggagucagugaccagugcuggggagagccuggagaccagcuucaaggcccgauaugccaccuuugcauuguccugugaaugccugggaaaccugucaucacauaguuuuauuugucuugggaggaaacuggcaucucuuuugcuuuguuaauuugcuuaaaagcuugcuugggaguguauaugcuuuguuugggggaggcuccagaggcacagcauuauagccaauaaaacaauaaaaagggaacagguuucaaaagcggaaagaugguaauuaguagguuugguauauucccuuaagaugcugcugagacaggaguagagcuuuucuuuagcuuuuagaagucuuguuagcuugagcauuagcaagaggcagacguuacaaaucagaguugaaagaggcagagagaguugugucucuuuguugucucugggagugauuugugaggucacggagauucagaucuucgcguacgguuggcagaggcacguggagucugcuuuucaagccaccaugguuugucugugucuucccucacagguucuccaaaugauaaguccaucaaugcccuucugaugacuguuacagguacggcacauggcucugcuccaccaugcuucuguugcucuguaaauucagaggaaaagggaaacuguuuucucccucaauuugaguaguaccgaaaccuuaauuacagagaauucaaauuuuaaaaggaaaaacgccuccuuuuccagauucuuuuucucugcuguuucuuacaugaccuccucaguccuauugugacagaagcggucccuauugacagagauuuucuacgauuuuugauugcugccccagcuucugcucuuaccucuaaaagugacuuagaaaaaugccacaugggagaccaauucaccagcuuucaaaaaaauccacaauagcucgugucuccuccuguguuggaauuggucagcauuuugucacuugagcacuagauaaaauaguugggugcauuuagggacuauguuauagaaaaauuacuuacuuuauuuauuauuuauuuauugagacagaaucuugcucuguugcccaggcuggaguguaguggcacagucucagcucacugcaaccuacaccucuuggguucaagugauucuccugccucagccuccugaguagcugguaauauaggcgugcaccaccacgcccagcuaauuuuuguauuuuuaguagagacaugguuucaccauguugcccaggcuggucucaaacuccugaccucaggugauccaccugccuuggccucccaaaaugcugggauuacaggcgugagccaccauccccagccagaaaaauuacuuauuuuaaacuuucuaauuuuauuuuuauuuuugagaaggagucucgcucuugucacccagaugggagugcaguggugcgaucucagcuaacugcaaccuccaccuccuggguucaagugauucuucugccucagcuucccaaguaguugggauuacaggcgccugcuaccaugcccagcuaauuuuuguauuuuuaguagagacagcguuucaccauguugcccaggcuggucucgaacuccugacuucaggugaucugcccaccucagccucucaaagugcugagauuacaggcauaagccacugcgcccggccagaaaaguuacuuauuuuaaacuuuagaucaugcuugggagagugagcugcucauucuacuugggguacauggaacugauuccagcagugggaccagauucaccugggccaucgcaugccugauucaugggcagccucacugagagcaguggcagauagagucaccugcuccauugcaguggcuuuuuccucuuugcucuuuuuuuucaauauuccugguugaauuuguguaguggaaugaucauaugaugcaacuaccguaauagaauuuauuugacaagcuagugcaauuaguuauuaaugaauguaaacuucacaggauuagaagggcuauguguuucacuauuuuuguaucuuuggguucuacaaaauauacuagagugucacauaauucgagaagggauuucaggaacguggauguuaacuacuaauaguuugaaaaugauacuaucuggggguuuccuuuuuuuuccacuucucuccaacauauuaagaaaacuauucggauauuauuuugccuuaugcaguagauugcuagugguugugaauuguguuuuaauaagaaccuguuuaugacuucaggauuuuuuauugguggaccuucuaauaugauuaguucugcuauuucugcggacuugggucgccaggagcucauccaaaggagcagugaagcuuuggccacugucacaggaauuguggaugguucggggagcauuggagcugcagugggccaggugagagaacaggagaggggcugggauucuagugucuucccucaaaggcggcugaaugugaaccugcccucugggccucaguagguggcacucuugugcuguagaacgcuguucccagagcccaaggacuuccgucuccccucaggaccagcugaugcguccuaauguagaaggacucuccauuguuuuuaguuccuuuuuucuacuuauacuucuagauucuuccugucugcaaauaagcuaagaccucguaagacagacagauccuucugccccagcccaccauccccuucuuucuuuccaggcugaacuugguauuccgugguggggggugcuucuuguuauccccaccuggcauguggaccccaccauugcugucucccgucucccucucccagacacucuacugcauacacguuccuuccugggccccgccagacauggccauggacucugcagcugcuucugaaucacucgcucugcuuccuguguauccaaaaaucucugacuguaucucaaagaguggcccauaagugucugguaucagaaucaucugggacacucauuaaaguacagaacaccaagcauacuacagacuugcugaguucgaaccuacagaucuguauuuucaacaaggcuucuuggugauucuuccacacucagauguuugagaucccuacacuaagauuggccuacuauacuuagaauuauuuacauugaccuuuuuuuuuuuugcauaaauucaacuuucucugggacagauauuucuuuucuggcagagucaugagucaugccucuucuaggauauaccacuacagauuguagaguacuaauuuuguagaaagauggaucugagagucaucuguauggauaaaaauaguugaaccuguggaagugaaugaaacauuuaauagggaaagagaauguuggccgagucucagggaaugcccaguggucaaagaaagaggaaggcagcagaguaaccuguagucaagggaacugcguuugagaaggcguuaguaaggucauggauguagagaggucaggagaaagagaacugaaggauuugucuuuuaggcucuuaguuuugacaucuaggaggucauuaauaaccuugaagauuauuguuacuugcuugaugggggugaauugcugaugucugauugcuagugguuaaugagagauaaguauugagguaaaguaagccauguuaauacuuugacuaccuagccguauuuuaauagucuauaugcacuuguuaaugucugucucucccacuguaacauaagcuuccugagcgcagcauuuuguuguauguucuucugucaccuuaguaccuagaacagugccuggcacacaguagacauuacuuguggaaugaaugacugauaugcuuggcauauuugauuauaagacuaaagggcaaaaaaccccaaagaaacaaaaaccuuagcaaagccuugaaaaauacgcuuaccugaucaugcccuggagcgggaaucgaaaaaugcucccagccaucaguucagacgucuucaccuaugggguagagaguggcugcauugggcauccuuuucugacauuauauuauuuuaaguuauccuuccuuacgaauguuuucuucacuaacuaaaugggugcauuauaaugaguauuucagagaauuugcuuuuauucagauugccucaccugccaguauccagaucccucacugugaacuuggguccuagacugaccuucaugguuggggaagcacgucuggaguaaaucacuguuagcuuuacucauuccucuuccauguugaguuuugaaugauuucccauugccuaaggggugaaaucccaaacucugugacuuagcguuaaccucuaucagcucuguccuuagccaguguacuaauuuacccugaauaacuuuguuaccccgucuuucccugacuucccaaguaaagaauuguuucuucuucagguugccauagcaguugaugcgguucuguaguaggcaccugucacgguguaaaggugaugcaccgugacaggugcucugcuuguuuccuucgucuuuguauucccaaugcuuagugcuuuuguugacacauacuagggguucaguaagauuaaauugcaguaucugcccaagagaaaugagaacaaauguccacauuaaaacuuguacaugaggcuaggugugguggcucaugccaguaaucccagcacuucgggaggccaaggcaggagaauuacuugaggccaagaguucaagaccagcccaagcaacauagugagacccucaucucuacaaaaaauaaaaaguuagcugagcauggugguaugugccugucccaacuacuuaggaggcugagacaggaggaucgcuugagccugggaagucaaggcugcagugagccaugaucacaccacuccaguccagccugggugacagagccagacccuggcucucucucucuauuuuuuuuuuuugagacagcaucuggcucuuaugcccaggcuggagugcaguggcaggaucuuggcucacugcaaccucugccuucugggacucaagcaauuuucccacugcagccucccaaguagcuuggacugcagguacccaccaccaugcccagcuaauuuuuguauuuuuuuuguagagacaggguuucaccacauugcccagacuggucucaaacuccugggcucaagugauccuccugccucagccucccaaagugcuaggauuacaggcaugagccacuugccuggacaagacccugucuaaaaaaaaaaaaaaagacaaaguugcagucaguuuggagccccccaugcuuccuguaguggaugaugagaccucugcuuuuuugcuacacaugaugugaucuaauauaaaucacauagucguucugcauuaauuuuuuucacuuguacauuucaguaauaaugugauugaagaaugcuacccuuuugugucugcggccaaauugauuuuugacaagggugccaggaccauucaauggggaaaggauggucucucaauaaauaguauugggaaaacuggauauccacgugaaaagaaugaaguuggagcugaggagugggagaggaaagaaaaaaaaaaaaaagaaugagguuggacccuaaccuuaccucauaugcaaaaauuaccucaaaauggauuaaaggccuaacuugaagaacuuaaaauuaugaaacucauagaagaaaacagggacaaaucuucaugacaaauauguacaaaugaccaauaagcacaugaagagucucagcauccuuagucauugggaaaaugcaaaucaaaaacacagugagcugugacuucaugcuuacuacgauggcuguaauuaaaaaacaggaaagggccgggcgcgguggcuuaagccuguaaucccagcacucugggaggccgaggcgggcggaucacgaggucaggagauggagacccuccuggcuaacacggugaaaccccgucucuacuaaaaauacaagaaaaauuggcugggcguuguggcgggugccuguggucccagcuacuugggaggcugaggcaggagaauggcgugaacccgggagguggagcuugcagugagcugagauugugccacugcacuccagccugggugacagagugagacuccaucucaaaaaaaaaaacaaacaggaaaggugacuggugcuggcaaggaugugcagaaauuggagcccugcauugcuggugggaaugcaaaaugaugcagcuucugugaaaaauacuuuggugcuucuuccaaaaaauuuaaauagaauuaccauaugacccagcacuccuagguauuucccgaaagauugaaaacugggggccgggcgcgguggcucaugccuguuaucccagcacuuugggagaccgaggugggcagaucacuugaggucaggaguucgagaccagccuggccaacauggugaaacccugucucuacuaaaaauacgaaaauuagcuggaugugguggcaggugccuguaaucccagcuacucaggaggcugaggcaggauaaucgcuugaaccugggaggcggagguugcagugagccaagaucacaccacugcacuccagccugggugacagaggaagacucucucaaaaaaaaaaaaaaaacaaaacugggacucagauauuuguaugucaacauuuauugcaguauuauucauaguagccaaaagguggaaacaacuuggguccaucagcaaaugaauggagaaacuaaaugugguauauccauaccagggaauacuaaugagccauuaaaaagaaaugaagggaaguuacagugagcugugaucauaccauuacacuacagucugggcaacagagaaagacccugucucuuuuaaucccagcacucugggaggcugagguggguggaucaccugagguuaggaguuugagaccagccuggccaacauggugaaaccucgucucuacuaaaaauacaaaaauuagcugggcgggggguggcaccucagcuacuugggaggcugaggcaagauaaucgcuugaaccugggaggaggagguugcagugagccaagaucgcaccacuguacuccagccugggugacagagcaagacuccauuuaaaaagaaagaaaguccgggcgcaguggcucacgcuuguaaucccagcacuuugggaggcugaagugagugaaucaccugaggucaggaguuccagaccagccugggcaauguggugaaaccucauuucuacuaaaaauagaaaaauuagccgagcaugguggcucacaccuguaaucccagcuacucuggaggcugaggcaggagaaucacuggaaccugggagacagagguugcaguaagcagagauugccccacugcacuccagccuaggugacagagcgagacuccaucuccaaaaaaaaaggagugaaguuccaauguaguuuaccuugaaagcauuaugcuaaguuaaacaagccagacauaaaaggacaaauacugugauuccauuuacacgaaauaucuagcauaggccaguucauggaaccagaaagaagagguuagcaagggcuggggagaugggcaguuaauuucuuaauaggaacagaguuucuauuuggaugaugaaaaaguuuggaaauagaugguaguguugguuguacagcauuaugaauguaacugauaccacuggauuguacacuuaaaaaugguuaaaaugggccgggcgcaguacgccuguaaucccagcacuuugggaggccgagguggacggaucacaaggucaggagauugagaccauccuggcuaauguggugaaaacccaucucuacuaaaaauacaaaaaauuggccgggugagguggcaggcgccuguagucccagcugcucgggaggcugaggcaggagaaugaugugaaccugggaggcagagcuugcagugagccgagauugcgccacugcacuccagccugagcgacagagcgagacuccaucucaaaaaaaaaaaaaaaguuaaaauggcaaauuuuauguaagcuauaucuuaccauaauaagagaaaaaaagaaaauggguuaaauaagugcaauuagauccuuuucaguaauugaaaguaaaauaaaagaauaugcuguaggaugcaaagguaguacugcaacacugugagcaaacagccuaauuggaaaaugaguggcauacuuaaagacaaacuauuuuugaggcaucaauuauaguaccuuucauuggaagaaagaaugauuaaaugggaguggcuugcggauguucaucuuccucucuaaauagcaaagugaauaaaaauaaaccuucugaacugacaacuucuauuauacgguuuuuccauuuggacucugcaugcuuaaaugggccauuaaucacagcaggcacauguauguggaagagcuuuguaaacugcaaaacauacaaauccuguucccuucuuauuuucuaaaauagccauguuuaaucuacuuuuuagcugcuuccuuuuaugaauuauaaagaauuauauuguaauuuuuuuuuccucccuuucaguauuuagugucucugauccgggacaagcuaggauggauguggguuuucuacuuuuucauucucaugguaagugugugccccuuuaaaaaaaaaaaagucauuuuucuguuaauuaaguucaaagcacuuacuuaagucacuucagcaaaacuguugauugcuuuuaaaggcuccuuugugaaaaguaacauuuuauuagucuaaaagacaucuucuucuucuucuucuucuuuuuuuuuuuuuuuuuuuuugaggcagagucucgcucuguugcccaggcugaagugugguggcgugaucuuggcucacugcagccucugccucccggguucaagcgauucucccaccucagccucccgaguagcugggauuacaggcgccugccaccacacccggcuaauuuuuguauuuuuaguagagaugggguuucaccauauuggccaggcuggucuugaacuucugaccucaggugauccacccgacucggccucccaaagugcugggauuacaggcaggagccacugcgccugacuucacauucuucuuugugaggaagaaaaaggcucucaguuugcucuugaccugagucuaaugaauauugccauuuaugauuucagaaaaacaagaagagacuuauuuaaaguaucaccagccccuaaucaguauacucuucuaggcuacccucuaucugcugaauauaauauaggaauucugaaguaaauuacaauguauaccaagcaacacuugaguuaaaagagaagcauugcuguaaucaacacugucauguuucccgguucuaaaauguugauaguuucuugaggaaauauuuaugaugcccuagacauucuuggcugggauucucuacuuucuuggaaauagccaauacagaguaaggccuuguuuauuuuuauuuauuuauuuuuuugagacaggucucauucugucacccaggcuggagugcaguggcacgaucacagcucacuacagccuugaccuccugggcucaggugaucuugggcucaggggguccucccaccucagccuccugauuaccugggacuauaggugugugccaccaugccugguaacuuuuugaauuuuuccuagaggugguuucaccauguugcccaggcuggucucaaacuccugaggcuuugugcuuuuaaaauauugcucucuguuaugagcugugacauacucaggcacguuauugugggacagugcucaagacaggucuaccugagagagucuggaaggcaccagggacgcauucaguauccuguccccaaauccagggcacuguaauugaaggcagcuuccaccacccguacuccaggcagcuguccucuugcuguggucaaggagccccaggauaguccagcuccaggaauaccuuggagcuuucaucuaauucccaucuagcuucuaaagacugggcccauguaacuuguguuccauuucugacauccaugcuaaguagagggaaguaucuugugaugaacuuucugaugugaucauacuaggaacuguaguagaaagaaaacuuuuaucuauuauaaggaucacuguuguucaucugagccucuggucucaguucucugcuccgccuauggcaaauuauuuguauguauuguucuuuuuuugggaacugaaaugugauguugaguguuuuguaauauuagccauaauuuucaaaaucauuuucuaauucauugaagauuaaacauuaucuuuguaugaagucaaaaugaauguaauuguccaaauccauuauuauguucaaaacaugacacucuaacagaaguaaacuguugcugcauauuuaauacuauuuucucuuuacagacaaguuguacaauuguguuuaucucgccauuaauagugagggaaauauucucucucgugcuaaggagacaggcucacauauugagggagugaccggugcccgcgagacagaaagaacaaugucagccacaucaggaccgcuggggcuucgagucugcccuaauuuggguuugucuaggagcuccagccugaucuuggauugucaggcgucucucaacacugccagccaccugagaugcugaccagcagugaaggcugcacuaguuuucuacacuacaggaauuacuguugaugauuuuugcuguuguuucaugaaugugccgagugacuucugacucugccagcaucuuugaccucugacucugcccgcgucuuuguuuggccuauugagguuuagcguuuuaaccuuaacuguuguuuuggacuugaacuuucucuagccuugaaaauggagugaacaggaggcaaagccacgcgugguuuguguuggugguauguuccacaaauggaagagaucauugcauuuugcuuugguaaugaguuuacagagagugggucaucuuugaagcaucaaauccugaucaaaugcucaagcuggaccgagcugcaagccugccuuggacaaagaaucccucuguucacuguggugggaaagaucacacuacaugccuguugauuggcucagucacucugugucugaucuaaacgucauucagcccuagaagcaugaauugcuucaaauuauugucaacuuguucucuuccauuuucauucaaauuaacuuugacuccuggaaguauugagucuuccuuucaaggaccauaagguacaucaguuaucuugaacauucugacguguaaaggaccauaagguacaucauuuaucuugaacauuccgacguguaacucacagccgaagcacuccaucccagauuuguugucugggaacuuaggauccucuaggaagcuaaucugcuuagucuauuuuuagaggauugaucucuggcacaagcagcuuccuggaguuaccucagcagaagacuagaauuagagaaaagggaaagaccuuuucuucuaguaagugucaaguacagaugcucuuugacuuaugaugggguuaugucccaguaaacccauuggaagucaaaugcauuuaauaccccugacuggacaccacagcuuagccucguccacccuaaauguacucagaacacuuagaauugcccacaguugggcagaaucaucuaacacaaacucuauuuuauaaucgaguguugaauauaucauguaauuuauugaauauuguacauuauguugaaauugcaaccauuucacaccauuguaaaguccaaaaaucagaagcugaggacugucuguacaugacauugaaucacaugaauggauuacuagggccugagggguguccguucuuuagaaaaauguagaguauauauaucuucagggcugugaauuccauacuaguuaucaauauuuuaagaucauucuguauauacauauuuuaaauuaugcaagcaaacuaggaggagaaugugcaauuuugagggauaccuaauuugcauucgguuaggggauauuuuucaaccucuugcuuuauacucugauaugggguguguuuaugaacuuguuaauguuauuuaaucaugcagauuuccaaucaguguauugcucauuuacugacaaaaagggaaaauacgaaacacagaaagggaaaauaaacugacuuuuauaaugaa
